(12) United States Patent
Michnick et al.

(10) Patent No.: US 7,166,424 B2
(45) Date of Patent: Jan. 23, 2007

(54) FRAGMENTS OF FLUORESCENT PROTEINS FOR PROTEIN FRAGMENT COMPLEMENTATION ASSAYS

(75) Inventors: Stephen William Watson Michnick, Westmount (CA); Marnie L. MacDonald, Pleasanton, CA (US); Jane Lamerdin, Livermore, CA (US)

(73) Assignee: Odyssey Thera Inc., San Ramon, CA (US)

( * ) Notice: Subject to any disclaimer, the term of this patent is extended or adjusted under 35 U.S.C. 154(b) by 0 days.

(21) Appl. No.: 10/724,178

(22) Filed: Dec. 1, 2003

(65) Prior Publication Data

US 2004/0137528 A1  Jul. 15, 2004

Related U.S. Application Data

(63) Continuation-in-part of application No. 10/353,090, filed on Jan. 29, 2003, which is a continuation of application No. 10/154,758, filed on May 24, 2002, now Pat. No. 6,929,916, which is a continuation of application No. 09/499,464, filed on Feb. 7, 2000, now Pat. No. 6,428,951, which is a continuation of application No. 09/017,412, filed on Feb. 2, 1998, now Pat. No. 6,270,964.

(60) Provisional application No. 60/461,133, filed on Apr. 9, 2003.

(51) Int. Cl.
*C12Q 1/25* (2006.01)
*C07K 14/00* (2006.01)

(52) U.S. Cl. .......................... 435/4; 530/350

(58) Field of Classification Search ................... 435/6, 435/4; 530/350
See application file for complete search history.

(56) References Cited

U.S. PATENT DOCUMENTS

| 6,270,964 | B1 * | 8/2001 | Michnick et al. | 435/6 |
| 6,294,330 | B1 * | 9/2001 | Michnick et al. | 435/6 |
| 6,428,951 | B1 * | 8/2002 | Michnick et al. | 435/4 |

OTHER PUBLICATIONS

Ghosh et al. Antiparallel Leucine Zipper-Directed Protein Reassembly: Application to the Green Fluorescent Protein. J. Am. Chem Soc. vol. 122, pp. 5658-5659 (2000).*

* cited by examiner

*Primary Examiner*—John S. Brusca
(74) *Attorney, Agent, or Firm*—Isaac A. Angres

(57) ABSTRACT

The present invention is directed to Protein-fragment Complementation Assays (PCAs) and assay compositions based on fluorescent proteins. The invention provides methods for fragmenting fluorescent proteins and generating mutant fragments with desired spectral characteristics for PCA. The invention encompasses assays and compositions based on fluorescent proteins from the species Aequorea, Anemonia and Anthozoa. In particular, the invention is directed to fragments of mutant fluorescent proteins having improved spectral properties over the wild-type proteins. The invention encompasses fragments of mutant versions of *A. Victoria* green fluorescent protein (GFP), in particular yellow fluorescent proteins (EYFP and super-EYFP), 'Venus', cyan, 'citrine', blue, cyan-green, and photoactivatable variants of GFP.

11 Claims, 12 Drawing Sheets

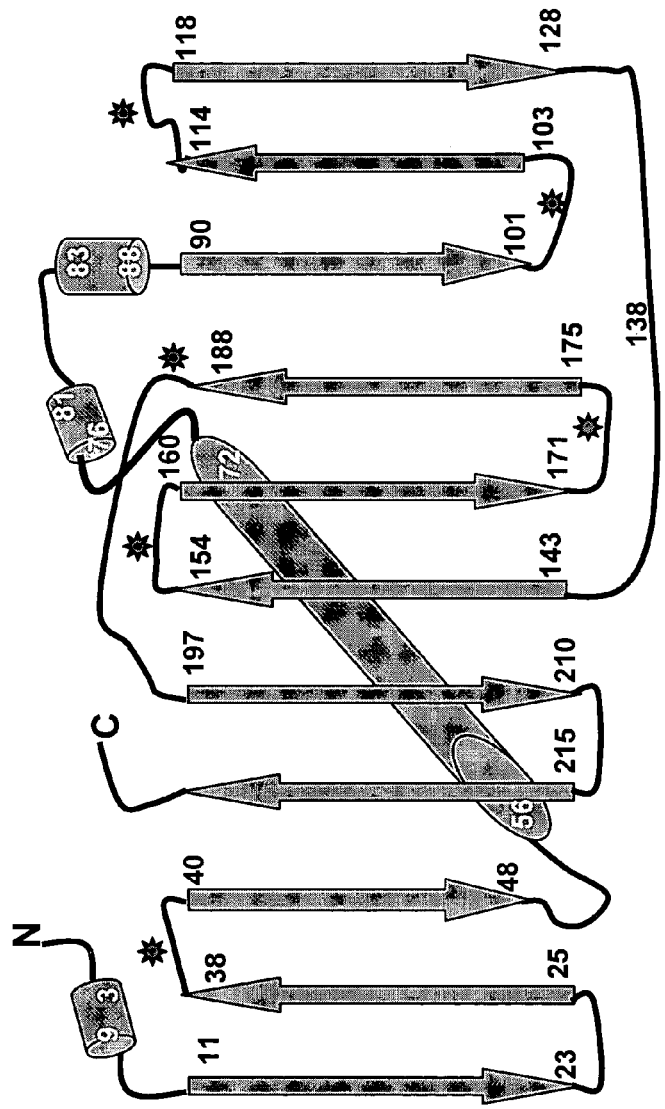

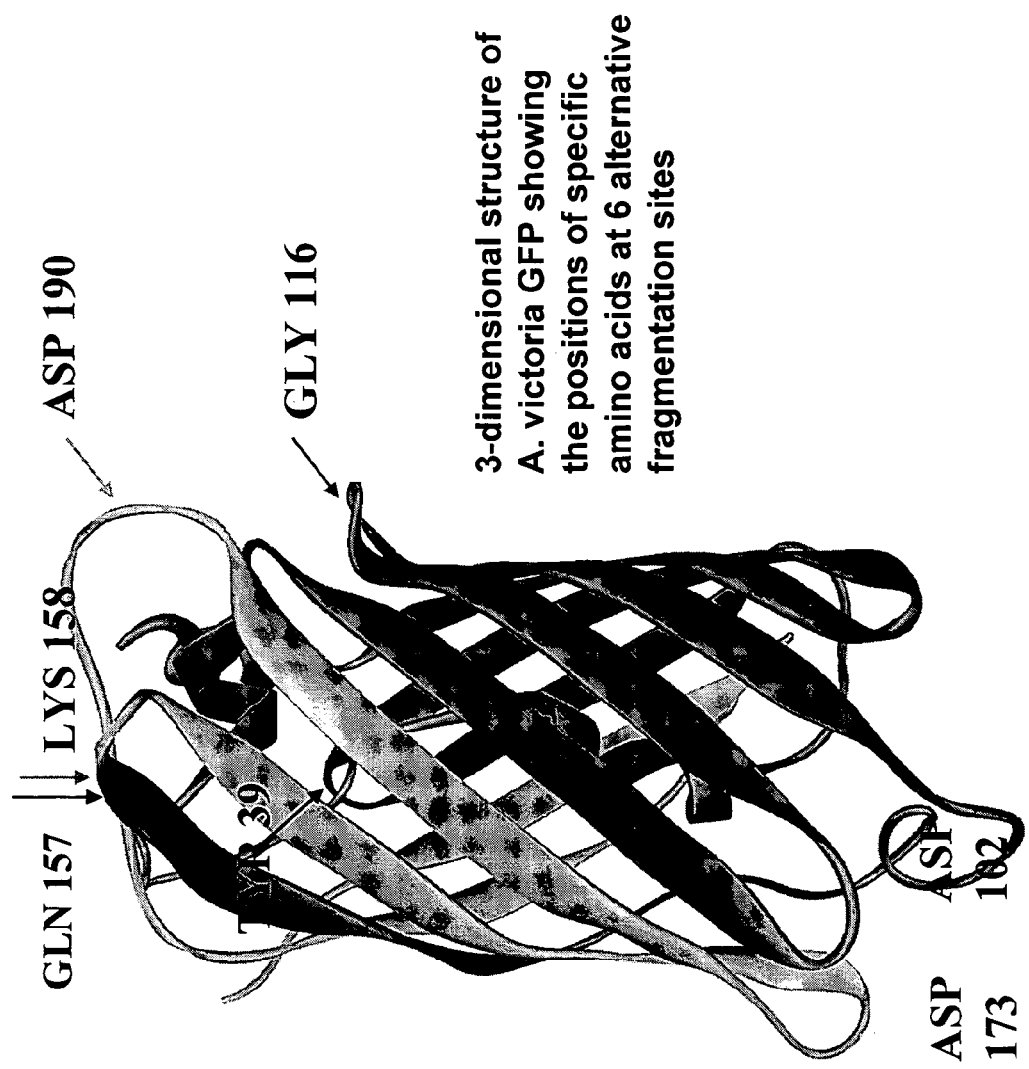

Examples of PCAs based on alternative fragmentation sites of YFP

* Note: amino acid changes are designated relative to wild-type GFP

Fig. 6
a. MEK-SEYFP[1] (F64L/S65G/V68L/S72A/M153T)*
   ERK-YFP[2]-T203Y*
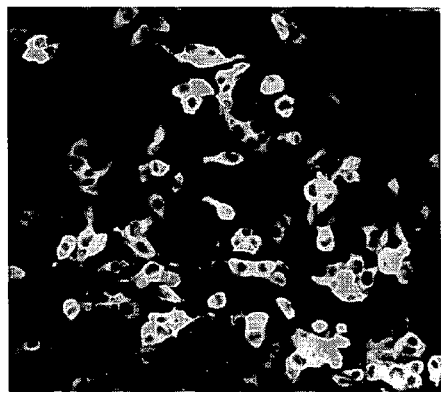
b. MEK-YFP[1] (S65G/V68L/S72A*)
   ERK-YFP[2] (T203Y*)
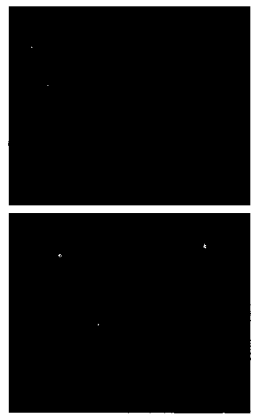
c. Single fragment control:
   Pdk2-YFP[1] (F64L/S65G/V68L/S72A)
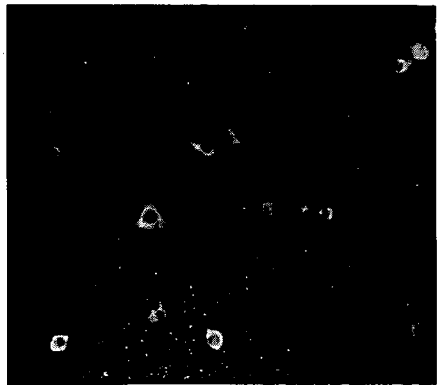
d. Single fragment control:
   Pdk2-YFP[2] (T203Y)
\* Note: amino acid changes are designated relative to wild-type GFP An intense fluorescent PCA (IFP PCA) based on mutant fragments of YFP Results shown are for MEK-IFP[1] + IFP[2]-ERK IFP[1]: F46L/F64L/S65G/V68L/S72A/M153T
IFP[2]: V163A/S175G/T203Y
Note: amino acid changes are designated relative to wild-type GFP Enhanced PCA signals based on mutant fragments: IFP (SEYFP-F46L) versus EYFP High-content assays based on IFP PCA:
cytokine-dependent translocation of p65/p50

Spectrally shifted (blue) PCAs based on mutant fluorescent protein fragments
(excitation= 436 nm, emission= 480 nm)

Negative Control p65/p50

14-3-3σ/14-3-3σ

Multi-color protein-fragment complementation assays (PCA)

FRAGMENTS OF FLUORESCENT PROTEINS FOR PROTEIN FRAGMENT COMPLEMENTATION ASSAYS

This application claims the priority benefit under 35 U.S.C. section 119 of U.S. Provisional Patent Application No. 60/461,133 entitled "Fragments of Fluorescent Proteins for Protein Fragment Complementation Assays", filed Apr. 9, 2003, which is in its entirety herein incorporated by reference. This Application is also a continuation-in-part of pending U.S. application Ser. No. 10/353,090 filed Jan. 29, 2003; which application is a continuation of pending U.S. application Ser. No. 10/154,758 filed May 24, 2002 now U.S. Pat. No. 6,929,916; which is a continuation of U.S. Ser. No. 09/499,464 filed Feb. 7, 2000; and now U.S. Pat. No. 6,428,951; which is a continuation of U.S. Ser. No. 09/017,412 filed Feb. 2, 1998; and now U.S. Pat. No. 6,270,964.

BACKGROUND OF THE INVENTION

This invention relates generally to the fields of biology, molecular biology, chemistry and biohemistry. Specifically, the invention is directed to protein-fragment complementation assays (PCAs) based on fluorescent proteins. This invention is directed to methods for the design and creation of suitable fragment pairs, to the compositions of the fragments, and to combinations suitable for PCA. Preferred embodiments include fragments of mutant fluorescent proteins having properties suitable for biotechnology applications.

The growing list of naturally fluorescent, bioluminescent or phosphorescent proteins includes GFP derived from Aequorea Victoria, and a growing number of sequence variants of GFP with useful properties. The list also includes the red fluorescent protein (RFP) derived from Discosoma; and the kindling fluorescent protein (KFP1) derived from Anemonia. These proteins are autocatalytic enzymes that are all capable of generating highly visible, efficiently emitting internal fluorophores as a result of endo-cyclization of core amino acid residues. Another common feature of the fluorescent proteins is that the signal is stable, species independent, and does not require any substrates or cofactors for the generation of a signal. These fluorescent proteins are remarkably similar structurally allowing similar principles of protein engineering to be applied across species.

The full-length DNA, and corresponding amino acid sequence of one isotype of GFP ("wild-type GFP") is shown in TABLE 1 and has been fully described and characterized (see e.g. Tsien et al., 1998, Ann. Rev. Biochem. 67: 509–44). The intact protein (FIGS. 1 and 2B) generates a strong visible absorbance and fluorescence from a p-hydroxybenzylideneimidazolone chromophore, which is generated by cyclization and oxidation of the protein's own Ser-Tyr-Gly sequence at positions 65 to 67. Newly synthesized fluorescent protein polypeptides need to mature properly before emitting fluorescence. The maturation process involves two steps: folding and chromophore formation. First, the protein folds into a native conformation, and then the internal tripeptide cyclizes and is oxidized. In this regard the fluorescent protein is an enzyme which autocatalyzes the cyclization reaction, requiring only molecular oxygen for completion of the reaction.

A variety of useful mutant versions of the full-length, wild-type GFP have been generated and have been termed 'Aequorea fluorescent protein (AFP) variants' or AFPs. These "mutant fluorescent proteins" have proven to have wide applicability for biology and biotechnology applications as a result of their improved spectral properties. Some of the reported GFP variants are shown in Table 2. By conventional usage, the positions of the mutations (as in Table 2 and throughout this invention) are denoted relative to the sequence of wild-type GFP (Table 1). Many of these AFPs exhibit vastly improved properties over the original wild-type GFP in terms of signal intensity, generating a fluorescence signal 5 to 30 times that of the wild-type protein. The enhanced GFP (EGFP), which is the basis for nearly all biology applications and for mutant fluorescent proteins, has improved codon usage for mammalian cells.

Starting with GFP, mutations at the site of the chromophore have been created which result in different color variants. Mutations of the side chains in contact with the chromophore have been shown to further enhance protein folding and brightness. Combinations of mutations have been created that have spectral shifts and that fold more rapidly at 37° C., producing brighter signals for cell biology applications. The most common spectral variants include the widely-used yellow (YFP/EYFP), cyan (CFP/ECFP) and BFP variants (R. Y. Tsien, 1998, "The Green Fluorescent Protein", in: *Annual Reviews of Biochemistry* 67: 509–544).

Additional mutants of GFP have been created with unique properties. These include a 'CGFP' variant with an excitation and emission wavelength intermediate between CFP and EGFP (J. Zhang et al., 2000, "Creating new fluorescent probes for cell biology", *Nature Reviews* 3: 906–918). The 'citrine' variant of YFP (YFP-Q69M) confers a lower pKa than for previous YFPs, indifference to chloride anion, twice the photostability of previous YFPs, and much better expression at 37° C. and in organelles (O. Griesbeck et al., 2001, "Reducing the Environmental Sensitivity of Yellow Fluorescent Protein", *J. Biol. Chem* 276: 29188–29194).

Several versions of YFP have been created using random mutagenesis. These mutant proteins have fluorescence intensities 3–30 times brighter than EYFP. They include the so-called super-EYFP (SEYFP) (EYFP—F64L/M153T/V163A/S175G) and 'Venus' (SEYFP-F46L) (T. Nagai et al., 2002, "A variant of yellow fluorescent protein with fast and efficient maturation for cell-biological applications", *Nature Biotech.* 20: 87–90). Venus contains the novel mutation, F46L, which at 37° C. greatly accelerates oxidation of the chromophore, the rate-limiting step of mutation. As a result of the additional SEYFP mutations, Venus SEYFP-F46L also folds well and is relatively tolerant of exposure to acidic or high chloride anion concentrations.

A photoactivatable form of GFP named PA-GFP (GFP-V163A/T203H) has been reported that, after intense irradiation with 413-nm light, increases fluorescence 100 times when excited by 488-nm light and remains stable for days under aerobic conditions (G. H. Patterson & J. L.-Schwartz, "A photoactivatable GFP for selective photolabeling of proteins and cells", *Science* 297: 1873–1877, 2002).

TABLE 1

Full-length Aequorea GFP nucleic acid sequence (716 bp) (SEQ ID No:1) and corresponding amino acid sequence (238 aa) (SEQ ID No:2). Amino acids are numbered at every 5th position. This sequence is for the wild-type protein. In "enhanced" versions of GFP (EGFP, EYFP, ECFP) a valine residue is inserted after the initiating methionine. The valine becomes amino acid # 2 and the remaining amino acids are shifted accordingly. Descriptions of GFP mutants (as in Table 2 and throughout the specifications) refer to the numbering shown below. Alternative fragmentation sites that are the subject of the present invention are shown at the following regions (underlined) amino acid residues 38–40 (region 1); residues 101–103 (region 2); residues 114–118 (region 3); residues 154–160 (region 4); residues 171–175 (region 5); and residues 188–190 (region 6). The positions of specific amino acid residues are shown for Tyrosine 39 (Y39), Aspartate 102 (D102), Glutamine 157 (Q157), Lysine 158 (K158), Aspartate 173 (D173) and Aspartate 190 (D190).

```
atg  agt  aaa  gga  gaa  gaa  ctt  ttc  act  gga  gtt  gtc  cca  att  ctt  gtt
Met  Ser  Lys  Gly  Glu  Glu  Leu  Phe  Thr  Gly  Val  Val  Pro  Ile  Leu  Val
1              5                        10                       15 gaa  tta  gat  ggt  gat  gtt  aat  ggg  cac  aaa  ttt  tct  gtc  agt  gga  gag
Glu  Leu  Asp  Gly  Asp  Val  Asn  Gly  His  Lys  Phe  Ser  Val  Ser  Gly  Glu
                    20                  25                       30 ggt  gaa  ggt  gat  gca  aca  tac  gga  aaa  ctt  acc  ctt  aaa  ttt  att  tgc
Gly  Glu  Gly  Asp  Ala  Thr  Tyr  Gly  Lys  Leu  Thr  Leu  Lys  Phe  Ile  Cys
          35                  Y39  40                       45 act  act  gga  aaa  cta  cct  gtt  cca  tgg  cca  aca  ctt  gtc  act  act  ttc
Thr  Thr  Gly  Lys  Leu  Pro  Val  Pro  Trp  Pro  Thr  Leu  Val  Thr  Thr  Phe
     50                       55                 60 tct  tat  ggt  gtt  caa  tgc  ttt  tca  agc  tac  cca  gat  cat  atg  aaa  cgg
Ser  Tyr  Gly  Val  Gln  Cys  Phe  Ser  Arg  Tyr  Pro  Asp  His  Met  Lys  Arg
65                       70                  75                            80 cat  gac  ttt  ttc  aag  agt  gcc  atg  ccc  gaa  ggt  tat  gta  cag  gaa  aga
His  Asp  Phe  Phe  Lys  Ser  Ala  Met  Pro  Glu  Gly  Tyr  Val  Gln  Glu  Arg
                    85                       90                      95 act  ata  ttt  ttc  aaa  gat  gac  ggg  aac  tac  aag  aca  cgt  gct  gaa  gtc
Thr  Ile  Phe  Phe  Lys  Asp  Asp  Gly  Asn  Tyr  Lys  Thr  Arg  Ala  Glu  Val
                    100  D102           105                 110 aag  ttt  gaa  ggc  gat  acc  ctt  gtt  aat  aga  atc  gag  tta  aaa  ggt  att
Lys  Phe  Glu  Gly  Asp  Thr  Leu  Val  Asn  Arg  Ile  Glu  Leu  Lys  Gly  Ile
          115  G116                120                      125 gat  ttt  aaa  gaa  gat  gga  aac  att  ctt  gga  cac  aaa  ttg  gaa  tac  aac
Asp  Phe  Lys  Glu  Asp  Gly  Asn  Ile  Leu  Gly  His  Lys  Leu  Glu  Tyr  Asn
     130                  135                 140 tat  aac  tca  cac  aat  gta  tac  atc  atg  gca  gac  aaa  caa  aag  aat  gga
Tyr  Asn  Ser  His  Asn  Val  Tyr  Ile  Met  Ala  Asp  Lys  Gln  Lys  Asn  Gly
145                 150                 155  Q157 K158           160 atc  aaa  gtt  aac  ttc  aaa  att  aga  cac  aac  att  gaa  gat  gga  agc  gtt
Ile  Lys  Val  Asn  Phe  Lys  Ile  Arg  His  Asn  Ile  Glu  Asp  Gly  Ser  Val
                    165                 170       D173           175 caa  cta  gca  gac  cat  tat  caa  caa  aat  act  cca  att  ggc  gat  ggc  cct
Gln  Leu  Ala  Asp  His  Tyr  Gln  Gln  Asn  Thr  Pro  Ile  Gly  Asp  Gly  Pro
               180                      185            D190 gtc  ctt  tta  cca  gac  aac  cat  tac  ctg  tcc  aca  caa  tct  gcc  ctt  tcg
Val  Leu  Leu  Pro  Asp  Asn  His  Tyr  Leu  Ser  Thr  Gln  Ser  Ala  Leu  Ser
          195                      200                 205 aaa  gat  ccc  aac  gaa  aag  aga  gac  cac  atg  gtc  ctt  ctt  gag  ttt  gta
Lys  Asp  Pro  Asn  Glu  Lys  Arg  Asp  His  Met  Val  Leu  Leu  Glu  Phe  Val
     210                 215                      220 aca  gct  gct  ggg  att  aca  cat  ggc  atg  gat  gaa  cta  tac  aaa
Thr  Ala  Ala  Gly  Ile  Thr  His  Gly  Met  Asp  Glu  Leu  Tyr  Lys
225                 230                 235
```

TABLE 2

Spectral characteristics of the major classes of
Aequorea fluorecent proteins (AFPs)

| Mutation | Common name | $\lambda_{exc}(\epsilon)$ | $\lambda_{em}(QY)$ | Rel. fl. @ 37° C. |
|---|---|---|---|---|
| Class 1, wild-type | | | | |
| None or Q80R | Wild type | 395–397 (25–30) 470–475 (9.5–14) | 504 (0.79) | 6 |
| F99S, M153T, V163A | Cycle 3 | 397 (30) 475 (6.5–8.5) | 506 (0.79) | 100 |
| Class 2, phenolate anion | | | | |
| S65T | | 489 (52–58) | 509–511 (0.64) | 12 |
| F64L, S65T | EGFP | 488 (55–57) | 507–509 (0.60) | 20 |
| F64L, S65T, V163A | | 488 (42) | 511 (0.58) | 54 |
| S65T, S72A, N149K, M153T, I167T | Emerald | 487 (57.5) | 509 (0.68) | 100 |
| Class 3, neutral phenol | | | | |
| S202F, T203I | H9 | 399 (20) | 511 (0.60) | 13 |
| T203I, S72A, Y145F | H9-40 | 399 (29) | 511 (0.64) | 100 |
| Class 4, phenolate anion with stacked π-electron system (yellow fluorescent proteins) (YFPs) | | | | |
| S65G, S72A, T203F | | 512 (65.5) | 522 (0.70) | 6 |
| S65G, S72A, T203Y | EYFP | 508 (48.5) | 518 (0.78) | 12 |
| S65G, V68L, Q69K S72A, T203Y | 10C Q69K | 516 (62) | 529 (0.71) | 50 |
| S65G, V58L, S72A, T203Y | 10C | 514 (83.4) | 527 (0.61) | 58 |
| S65G, S72A, K79R, T203Y | Topaz | 514 (94.5) | 527 (0.60) | 100 |
| F46L | EYFP-F46L | 515 (78.7) | 528 (0.61) | ND |
| F64L, M153T, V163A, S175G | SEYFP | 515 (101) | 528 (0.56) | ND |
| F46L, F64L, M153T, V163A, S175G | SEYFP-F46L ('Venus') | see: Nagai et al., Nature Biotech. 20: 87–90, 2002 | | |
| V68L, Q69M | 'Citrine' | see: Griesbeck et al., J. Biol. Chem 276: 29188–29194 (2001) | | |
| V163A, T203H | PA-GFP | see: Patterson et al., Science 297: 1873–1877, 2002 | | |
| Class 5, indole in chromophore (cyan fluorescent proteins) (CFPs) | | | | |
| Y66W | | 436 | 485 | — |
| Y66W, N146I, M153T, V163A | W7 | 434 (23.9) 452 | 476 (0.42) 505 | 61 |
| F64L, S65T, Y66W, N146I, M153T, V163A | W1B or ECFP | 434 (32.5) 452 | 476 (0.4) 505 | 80 |
| S65A, Y66W, S72A, N146I, M153T, V163A | W1C | 435 (21.2) | 495 (0.39) | 100 |
| T203Y | CGFP | see: Sawano & Miyawaki, Nucleic Acid Res. 28: E78 (2000) | | |
| Class 6, imidazole in chromophore (blue fluorescent proteins) (BFPs) | | | | |
| Y66H | BFP | 384 (21) | 448 (0.24) | 18 |
| Y66H, Y145F | P4-3 | 382 (22.3) | 446 (0.3) | 52 |
| F64L, Y66H, Y145F | EBFP | 380–383 (26.3–31) | 440–447 (0.17–0.26) | 100 |
| Class 7, phenyl in chromophore | | | | |
| Y66F | | 360 | 442 | — |

TABLE 3

Alignment of wild type Aequorea victoria GFP and Aequorea-derived fluorescent proteins (Zhang et al. 2002). New variants of green fluorescent protein (GFP) (SEQ ID No:2) that encode proteins with altered excitation and emission wavelength properties relative to wild type GFP are aligned. These include the mammalian codon-usage optimized ECFP (cyan) (SEQ ID No:8), EGFP (green) (SEQ ID. No:3), (cyan), EGFP (green), and EYFP (yellow) (SEQ ID No:4) variants. Three more recent variants of EYFP include EYFP-Q69M (Citrine) (SEQ ID No:5), super-EYFP (SEYFP) (SEQ ID No:6), and SEYFP-F46L ('Venus') (SEQ ID No:7).

```
GFP         1 -MSKGEELFTGVVPILVELDGDVNGHKFSVSGEGEGDATYGKLTLKFICTTGKLPVPWPT
EGFP        1 MV..........................................................
EYFP        1 MV..........................................................
EYFP-Q69M   1 MV..........................................................
SEYFP       1 MV..........................................................
SEYFP-F46L  1 MV..................................................L.......
ECFP        1 MV..........................................................

GFP        60 LVTTFSYGVQCFSRYPDHMKQHDFFKSAMPEGYVQERTIFFKDDGNYKTRAEVKFEGDTL
EGFP       61 ....LT......................................................
EYFP       61 .....G..L...A................................................
EYFP-Q69M  61 .....G..LM..A................................................
SEYFP      61 ....LG..L...A................................................
SEYFP-F46L 61 ....LG..L...A................................................
ECFP       61 ....LTW......................................................

GFP       120 VNRIELKGIDFKEDGNILGHKLEYNYNSHNVYIMADKQKNGIKVNFKIRHNIEDGSVQLA
EGFP      121 ............................................................
EYFP      121 ............................................................
EYFP-Q69M 121 ............................................................
SEYFP     121 ....................................T.........A...........G....
SEYFP-F46L 121 ...................................T.........A...........G....
ECFP      121 .........................I......T.........A................

GFP       180 DHYQQNTPIGDGPVLLPDNHYLSTQSALSKDPNEKRDHMVLLEFVTAAGITHGMDELYK
EGFP      181 .............................................L.......
EYFP      181 ...........Y.................................L.......
EYFP-Q69M 181 ...........Y.................................L.......
SEYFP     181 ...........Y.................................L.......
SEYFP-F46L 181 ...........Y.................................L.......
ECFP      181 .............................................L.......
```

Fluorescent proteins from species other than *Aequorea victoria* have also been isolated and characterized. The growing list includes a green fluorescent protein from *Renilla reniformis*, and a number of fluorescent proteins from the coral Anthozoa. These include the red fluorescent protein from Discosoma (DsRed) (M. V. Matz et al., 1999, Nature Biotech. 17:969–973) which has been crystallized (Yarbrough et al., 2001, Proc. Natl. Acad. Sci. 98: 462–467) and has found wide applicability as a biology tool. Although the coral fluorescent proteins have only 26–30% sequence identity with Aequorea GFP, they are remarkably similar structurally. In particular, the coral fluorescent proteins share the same β-can fold first observed in GFP. All the key secondary structure elements observed in GFP could be easily detected in the coral proteins in the same arrangements, and remarkable similarity was observed in the stretches forming the "caps' of the can. Key residues thought to be involved in chromophore formation in GFP are also conserved in the coral proteins, including an Arginine at residue 96, the Tyrosine at residue 66 and Glycine at residue 67.

The structural homology of fluorescent proteins among various species means that many of the principles of genetic engineering and protein engineering previously applied to GFP can also be applied to these fluorescent proteins to create variants with desirable properties for biological applications and biotechnology.

The availability of a bright orange-red fluorescent protein with a high quantum yield would be particularly useful for biological studies as it is spectrally distinct from the previously described green, yellow and cyan variants of GFP. DrFP583, commonly known as DsRed, is a 28-kDa polypeptide that has essentially the same chromophore as GFP, which is autocatalytically formed from an internal Gln-Tyr-Gly (residues 66–68) tripeptide. DsRed is remarkably similar structurally to *A. victoria* GFP. In fact, the overall fold of DsRed is virtually identical to GFP, consisting of a slightly irregular 11-stranded beta-barrel (described as a beta can) with a coaxial central helix and alpha-helical caps on the barrel ends. The sequence alignment of the coral fluorescent proteins with Aequorea GFP is shown in Table 4.

A number of mutant versions of DsRed have now been described with faster rates of chromophore maturation than the wild-type protein (B. J. Bevis and B. S. Glick, Nature Biotech. 20: 83–86, 2002). Importantly, DsRed has recently been engineered into a monomeric form (mRFP) (R. E. Campbell et al., Jun. 11, 2002, "A monomeric red fluorescent protein", *Proc. Natl. Acad. Sci.* 99(12): 7877–7882) which is more useful than the multimeric protein as a reporter. mRFP1 is a monomer, the signal matures >10-fold faster than for DsRed, and the monomeric protein has minimal emission at wavelengths suitable for excitation of GFP.

A unique GFP-like chromoprotein asCP from the sea anemone Anemonia sulcata was recently discovered (Chudakov, D. M., et al. 2003, Kindling fluorescent proteins for precise in vivo photolabeling". Nat. Biotechnol. 21, 191–194). asCP is initially nonfluorescent, but in response to intense green light irradiation it becomes brightly fluorescent (kindles) with emission at 595 nm. Kindled asCP relaxes back to the initial nonfluorescent state with a half-life of <10 seconds. Alternatively, fluorescence can be "quenched" instantly and completely by a brief irradiation with blue light. A mutant (asCP A148G, or KFP1) has been generated which is capable of unique irreversible photoconversion from the nonfluorescent to a stable bright-red fluorescent form that has 30 times greater fluorescent intensity than the unkindled protein. This "kindling fluorescent protein" can be used for precise in vivo photolabeling to track the movement of cells, organelles and proteins.

Fluorescent proteins have proven to be useful reporters for monitoring gene expression and protein localization in vivo and in real time (J. M. Tavare et al., 2001, J. Endocrinol. 170: 297–306; Thastrup et al., U.S. Pat. No. 6,518,021). Such assays measure cellular events linked to individual proteins, as compared with binary or higher-order events. A number of other useful applications of fluorescent proteins have been described, including the construction of biochemical sensors and the creation of innovative fusion constructs to analyze protein dynamics in living cells. For the measurement of bimolecular events, FRET (fluorescence resonance energy transfer) or BRET (bioluminescence resonance energy transfer) assays have been well described (A. Miyawaki & R. Tsien, 2000, Methods in Enzymology 327: 472–500; G. W. Gordon et al., 1998, Biophys. J. 74: 2702–2713). GFP, BFP, CFP and RFP have been used in FRET or BRET assays to detect protein-protein interactions, monitor protease activity, and create calcium indicators, among other uses.

It is important to note that all the above-mentioned applications rely upon tagging of proteins of interest with a functional, full-length (or substantially full-length) fluorescent protein (lumiphore). None of the references cited above describe compositions or uses of fragments of fluorescent proteins.

Protein-fragment complementation assays (PCA) represent a general method for the construction of assays for the detection and quantitation of biomolecular and drug interactions (J. N. Pelletier, J. N., Remy, I. and Michnick, S. W. 1998, Protein-Fragment complementation Assays: a general strategy for the in vivo detection of Protein-Protein Interactions, J. Biomolecular Techniques 10:32–19; Remy, I., Pelletier, J. N., Galarneau, A. & Michnick, S. W. 2002, Protein Interactions and Library Screening with Protein Fragment Complementation Strategies, in: Protein-protein Interactions: A Molecular Cloning Manual, Cold Spring Harbor Laboratory Press Chapter 25, 449–475; Michnick, S. W., Remy, I., C.-Valois, F. X., Vallee-Belisle, A., Galarneau, A. & Pelletier, J. N., 2000, Detection of Protein-Protein Interactions by Protein Fragment Complementation Strategies, Parts A and B, in: Methods in Enzymology 328: 208–230.; J. N. Pelletier & S. W. Michnick., 1997, A Strategy for Detecting Protein-Protein Interactions in vivo Based on Protein Fragment Complementation. *Protein Engineering*, 10(Suppl.): 89.).

PCA involvse the oligomerization-assisted complementation of fragments of a reporter protein such as a monomeric enzyme, a fluorescent protein, luminescent protein or phosphorescent protein. Dimeric and multimeric enzymes can also be used in PCA, however, monomeric proteins are preferred. As described by Michnick et al. (U.S. Pat. No. 6,270,964) the ideal properties of a protein suitable for PCA are: 1) a protein or enzyme that is relatively small and monomeric; 2) for which there is a large literature of structural and functional information; 3) for which simple assays exist for the reconstitution of the protein or activity of the enzyme; and 4) for which overexpression in eukaryotic and prokaryotic cells has been demonstrated.

FIG. 1 of U.S. Pat. No. 6,270,964 shows a general description of a PCA. The gene for a protein or enzyme is rationally dissected into two or more fragments. Using molecular biology techniques, the chosen fragments are subcloned, and to the 5' ends of each, proteins that either are known or thought to interact are fused. Co-transfection or transformation of these DNA constructs into cells is then carried out. Reassembly of the probe protein or enzyme from its fragments is catalyzed by the binding of the test proteins to each other, and reconstitution is observed with some assay. It is crucial to understand that these assays will only work if the fused, interacting proteins catalyze the reassembly of the protein or enzyme. That is, observation of reconstituted protein or enzyme activity must be a measure of the interaction of the fused proteins.

U.S. Pat. No. 6,270,964 taught the principles, methods and applications of PCAs for a large number of useful reporters that can generate a fluorescent signal (see Table 1). Example 3 of that patent describes various embodiments of PCAs including a number of specific reporters suitable for PCA. Details were described for glutathione-S-transferase, firefly luciferase, xanthine-guanine phosphoribosyl transferase (XPRT), diaphorase, adenosine deaminase, bleomycin binding protein, hygromycin-B-phosphotransferase, histidinol NAD+oxidoreductase and Aequorea green fluorescent protein (GFP). Table 1 of U.S. Pat. No. 6,270,964 described an even larger list of other reporters meeting the criteria for PCA.

In Example 3 of U.S. Pat. No. 6,270,964 a PCA based on GFP was described including its properties and advantages: "GFP from *Aequorea victoria* is becoming one of the most popular protein markers for gene expression. This is because the small, monomeric 238 amino acids protein is intrinsically fluorescent due to the presence of an internal chromophore that results from the autocatalytic cyclization of the polypeptide backbone between residues Ser65 and Gly67 and oxidation of the bond of Tyr 66. The GFP chromophore absorbs light optimally at 395 nm and possesses also a second absorption maximum at 470 nm. This bi-specific absorption suggests the existence of two low energy conformers of the chromophore whose relative population depends on the local environment of the chromophore. A mutant Ser65Thr that eliminates isomerization results in a 4 to 6 times more intense fluorescence than the wild type. Recently the structure of GFP has been solved by two groups, making it a candidate for a structure-based PCA design which we have begun to develop. As with the GST assay we are doing all of our initial development in *E. Coli* with GCN4 leucine zipper-forming sequences as oligomerization domains. Direct detection of fluorescence by visual observation under broad spectrum UV light will be used. We will also test this system in COS cells, selecting for co-transfectants using fluorescence activated cell sorting." The issued claims of U.S. Pat. No. 6,270,964, U.S. Pat. No. 6,294,330 and U.S. Pat. No. 6,428,951 include fluorescent proteins in addition to other reporter classes. PCAs have been used to screen diverse peptide libraries (J. N. Pelletier, et al., 2000, Nature Biotech. 17: 683–690) and cDNA or antibody libraries (E. Moessner et al., 2001, J. Mol. Biol. 308: 115–122; I. Remy et al., submitted for publication); to quantify the association constants of protein domains such as parallel and anti-parallel leucine zipper-forming sequences (K. M. Arndt et al., 2000, J. Mol. Biol. 295: 627–639; I. Ghosh et al., 2000, J. Am. Chem. Soc 122: 5658–5659); to detect the drug-induced association and dissociation of protein complexes (I. Remy and S. W. Michnick, 1999, Proc Natl Acad Sci USA 96: 5394–5399); to measure the ligand-induced activation of cellular receptors (I. Remy et al., 1999, Science 283: 990–993); to study transcription factor complexes in live cells (R. Subramaniam et al., 2001, Nature Biotech. 19: 769–772, 2001); to quantitate elements of signal transduction pathways in real time (I. Remy and S. W. Michnick, 2001, Proc Natl Acad Sci USA, 98: 7678–7683, 2001; A. Galarneau et al., 2002, Nature Biotech. 20: 619–622); and to pinpoint the subcellular locations of protein-protein complexes (I. Remy and S. W. Michnick, 2001, Proc Natl Acad Sci USA 98: 7678–7683; R. Subramaniam et al., 2001, Nature Biotech., 19: 769–772; C.-D. Hu et al., Molecular Cell 9: 789–798, 2002; H. Yu et al., submitted for publication).

Subsequent to our inventions describing the use of GFP for PCA, Ghosh et al. (J. Am. Chem. Soc 122:5658–5659, 2000; US 2002/0146701) used a GFP PCA to study GCN4 leucine zipper oligomerization in a manner originally proposed by Michnick et al. They showed antiparallel leucine zipper-directed reassembly of GFP fragments in bacteria. A single GFP variant was chosen for these studies and a single fragmentation site was used. The authors did not disclose additional principles or methods for fragmenting a fluorescent protein based on rational design beyond the principles first described in Michnick et al. (e.g. U.S. Pat. No. 6,270,964). Moreover, other than the fragment pair used in the leucine zipper study, Ghosh and coworkers did not disclose specific assay compositions useful for PCA.

Hu et al. (Molecular Cell 9: 789–798, 2002) described a PCA based on a yellow variant of GFP, where the fragments of YFP were fused either to parallel leucine zippers or to Rel family proteins. However, additional principles and methods of engineering fluorescent proteins, and fragment compositions, were not described by Hu and coworkers. Moreover, the prior art is silent on the topic of whether mutations known to affect the properties of intact fluorescent proteins would confer similar properties on polypeptide fragments used for PCA.

Since fluorescent protein PCAs do not depend upon external cofactors or substrates for signal generation, they are particularly useful for the construction of cell-based assays. A suite of fluorescent protein PCAs would enable a large number of useful assays with differing spectral properties. For example, fluorescent proteins with high quantum yields could be engineered into PCA fragments to allow detection of rare events within cells, such as complexes between proteins expressed at very low levels, or low-affinity complexes between enzymes and their substrates. In addition, PCAs with red-shifted emissions would provide improved signal to noise relative to cellular autofluorescence which often occurs in the green channel. Importantly, fragments generating different color PCAs could be combined to allow simultaneous monitoring of two, three, or more cellular events (multicolor PCA). Finally, fluorescent protein PCAs could be used to create multicolor arrays for rapid diagnostics. For example, multicolor arrays based on antibodies binding to different antigens would allow the rapid and simultaneous detection of bio-warfare agents.

OBJECTS AND ADVANTAGES OF THE INVENTION

It is an object of the present invention to provide methods for designing and engineering fluorescent protein fragments and mutant fragments for PCA.

It is a further object of the invention to describe a large number of fragment pairs and compositions useful for PCA.

Another object of the invention is to teach that any useful sequence variant of an intact fluorescent protein can be engineered into the PCA fragments, generating assays with a variety of spectral and physical properties.

A further object of the invention is to provide compositions of PCA fragments, incorporating a wide range of mutations that confer useful properties.

A still further object of the invention is to provide multicolor PCAs'.

The advantage of the invention is the ability to create 'designer' PCAs with a range of useful properties for a variety of applications.

SUMMARY OF THE INVENTION

The present invention relates to a composition comprising complementary fragments of a protein, said fragments generating an optically detectable signal when associated.

The invention also relates to fragments derived form fluorescent proteins and mutant fluorescent proteins.

The instant invention also describes complementary fragments of mutant fluorescent proteins which differ from the corresponding fragments of the wild-type protein by at least one amino acid.

The invention further relates to complementary fragments selected from the group consisting of: Seq. ID NO: 20 to Seq. ID NO: 1067.

The invention also describes a composition selected from Seq. ID NO: 20 to Seq. ID NO: 1067 which are further fused to a separate molecule.

The invention also provides a composition comprising complementary fragments of a mutant protein, said fragments generating an optically detectable signal when associated, wherein each fragment is fused to a separate molecule.

The invention is further directed to protein fragment complementation assays for the detection of molecular interactions comprising a reassembly of separate fragments from an optically detectable protein wherein reassembly of the fragments is operated by the interaction of molecular domains fused to each fragment, wherein reassembly of the fragments is independent of other molecular processes and wherein said reassembly is detected by means of reconstitution of activity of said optically detectable protein.

The invention also provides a method for detecting biomolecular interactions said method comprising: (a) selecting an appropriate optically detectable protein; (b) effecting fragmentation of said optically detectable protein such that said fragmentation results in reversible loss of protein function; (c) fusing or attaching fragments of said optically detectable protein separately to other molecules; (d) reassociating said protein fragments through interactions of the molecules that are fused or attached to said fragments; and (e) detecting the resulting optical signal.

The present invention also concerns the design and engineering of protein-fragment complementation assays based on fluorescent proteins. Methods for fragmenting fluorescent proteins and creating mutant fragments with specific properties are described, based on fluorescent proteins derived from Aequorea, Anthozoa and Anemonia species. Finally, a large number of fragment compositions and fragment pairs are provided that incorporate mutations with useful properties generating green, yellow, cyan, blue or red signals. Detailed examples of fluorescent protein PCAs are shown with numerous mutants of Aequorea fluorescent proteins, demonstrating the engineering principles and showing that mutations conferring useful properties to the full-length protein can also be conferred to the fragments. The invention also provides methods and compositions for the construction of multi-color PCAs.

BRIEF DESCRIPTION OF THE DRAWINGS

FIGS. 1a and 1b show regions in which Aequorea fluorescent proteins can be fragmented. FIG. 1A shows six alternative loops (asterisked) where fragmentation can be effected relative to the linear sequence. FIG. 1B shows specific amino acid residues at the sites (see arrows), relative to the three-dimensional structure of the protein; amino acid residues at the fragmentation sites are numbered relative to wild-type GFP.

FIG. 6 shows the bright signal generated by a super-enhanced PCA (panel a) with mutations that enhance the folding of YFP fragments as compared with a non-enhanced PCA (panel b). The sub-cellular location of protein-protein complexes can also be seen by fluorescence microscopy. Individual YFP fragments are incapable of fluorescing (c and d).

DETAILED DESCRIPTION OF THE INVENTION

Fluorescent proteins are particularly attractive for PCAs because they require no external substrates or probes for the generation of the fluorescent signal. However, fluorescent proteins present certain design challenges because of their unique structure and the requirement for internal formation of an active chromophore for generation of the fluorescent signal. The present invention encompasses the design criteria for fragmentation of a fluorescent protein, which are described below.

Figure 2:
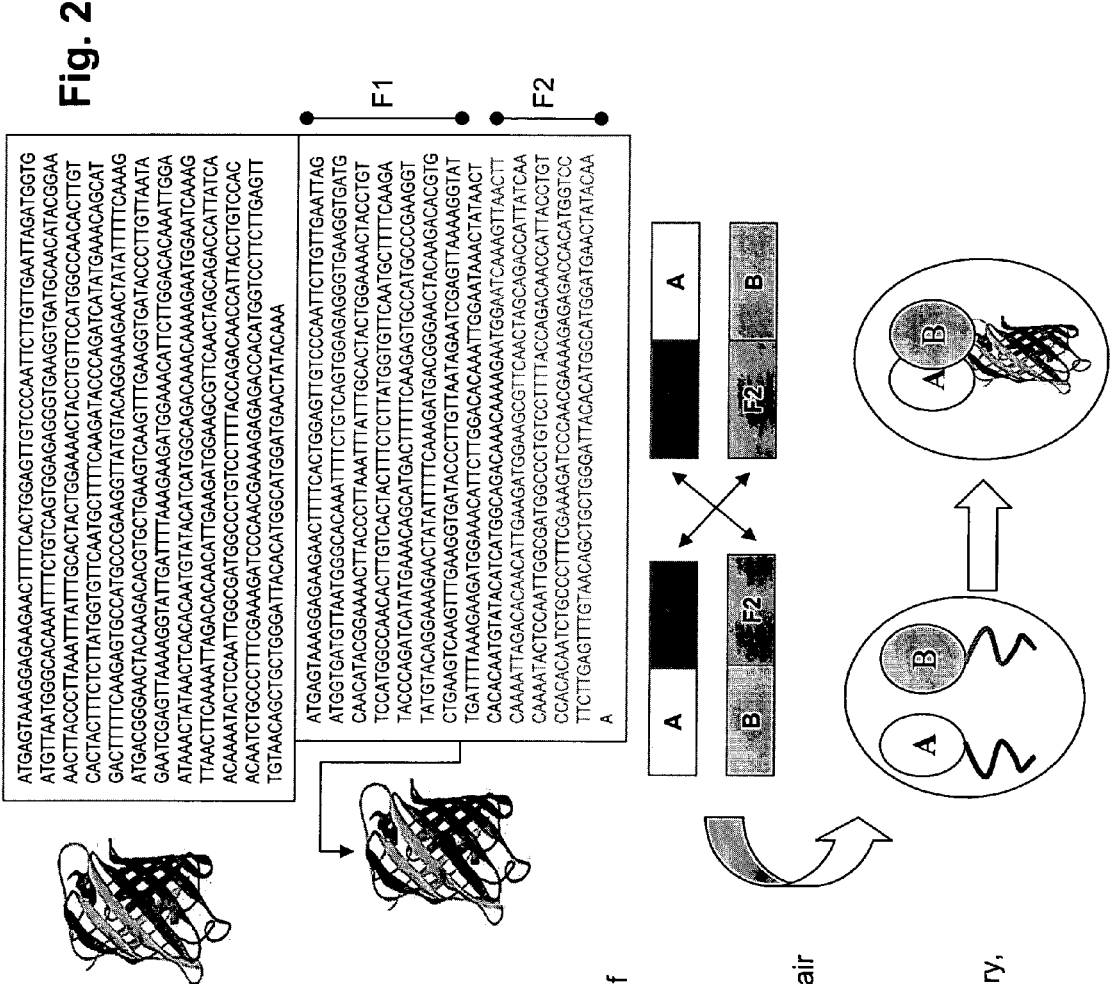
FIG. 2 depicts the strategy for design and creation of a fluorescent protein-fragment complementation assay, exemplifying the full length nucleotide sequence of wild type A. Victoria GFP (SEQ ID NO:1) (shown in the upper box) and two possible nucleotide fragments F1 and F2 thereof (lower box) obtained by fragmentation after residue 158 of the corresponding amino acid.

FIG. 2 describes the steps involved in creating a PCA based on a fluorescent protein. The first step is the selection of a fluorescent protein and its corresponding DNA sequence. Any fluorescent protein can be used for PCA based on the design principles that are the subject of the present invention. The choice of a fluorescent protein depends on the desired wavelength, instrumentation, and sensitivity required for the assay of interest. DNA fragments of the selected reporter are then made, using one of the methods described herein. In the first example, we describe the use of rational design to determine where to fragment a fluorescent protein. Because the fluorescent proteins have similar structures, we first describe the design principles for the example of A. victoria GFP.

GFP is an 11-stranded β-barrel with the highly unusual feature of having an α-helix that is thread through the central axis of the β-barrel (Ormo et al., Science 273:1392–95, 1996; F. Yang et al., Nat. Biotechnol. 14:1246–5121, 1996; R. Heim et al., Nature 373: 663–64, 1995). FIG. 1A shows a two-dimensional view of the protein; the 11 strands of the barrel are shown in relation to the central alpha-helix, and the amino acid positions at the ends of the barrel are numbered. FIG. 1B shows the 3-dimensional structure of the folded protein; the positions of specific residues at the loops are noted (all numbering is relative to the wild-type GFP). The chromophore is attached to the α-helix and is buried almost completely in the center of the β-barrel cylinder. Almost all the primary sequence is used to build the β-barrel and axial helix. The chromophore is a p-hydroxybenzylidene-imidazolinone formed from residues 65–67, which are Ser(Thr)-Tyr-Gly in the native protein (1,2). The chromophore is a 4-(p-hydroxybenzylidene)imidazolidin-5-one attached to the peptide backbone through the 1- and 2-positions of the ring. First, GFP folds into a nearly native conformation, then the imidazolinone is formed by nucleophilic attack of the amide of Gly67 on the carbonyl of residue 65, followed by dehydration. Finally, molecular oxygen dehydrogenates the Cα-Cβ bond of residue 66 to put its aromatic group into conjugation with the imidazolinone (3).

There are obvious features of the structure that should not be disrupted and therefore, by default, alternatives to such regions are chosen for fragmentation. The design criteria for fluorescent protein PCAs include the following:

(1) Fragmentation is made in β-turns or loops at the extreme ends of individual strands so as not to disrupt the barrel structure. Preferred regions for fragmentation are shown in FIG. 1A, with specific amino acids corresponding to the regions shown in the 3-dimensional structure in FIG. 1B.

(2) The chromophore is deeply buried in the β-barrel. It is likely that this is required to isolate the chromophore coding sequence, both to assure efficient formation of the chromophore and to maintain both rigid conformation and coordination to the side chains of other amino acids that provide GFP with its unique spectral characteristics. Isolation of the chromophore from solvent is maintained both by being embedded in the β-barrel and also by barrel "capping" structures at either end of the barrel. These caps include: (a) Cap at N-terminus of internal helix: Residues 19–30 strand; Residues 133–143 hairpin; Residues 50–57 (This is the N-terminus of the internal helix); and (b) Cap at C-terminus of internal helix: Residues 1–10, helix; Residues 77–98, helix; Residues 191–197, strand. Neither of these regions should be disrupted.

Figure 4:
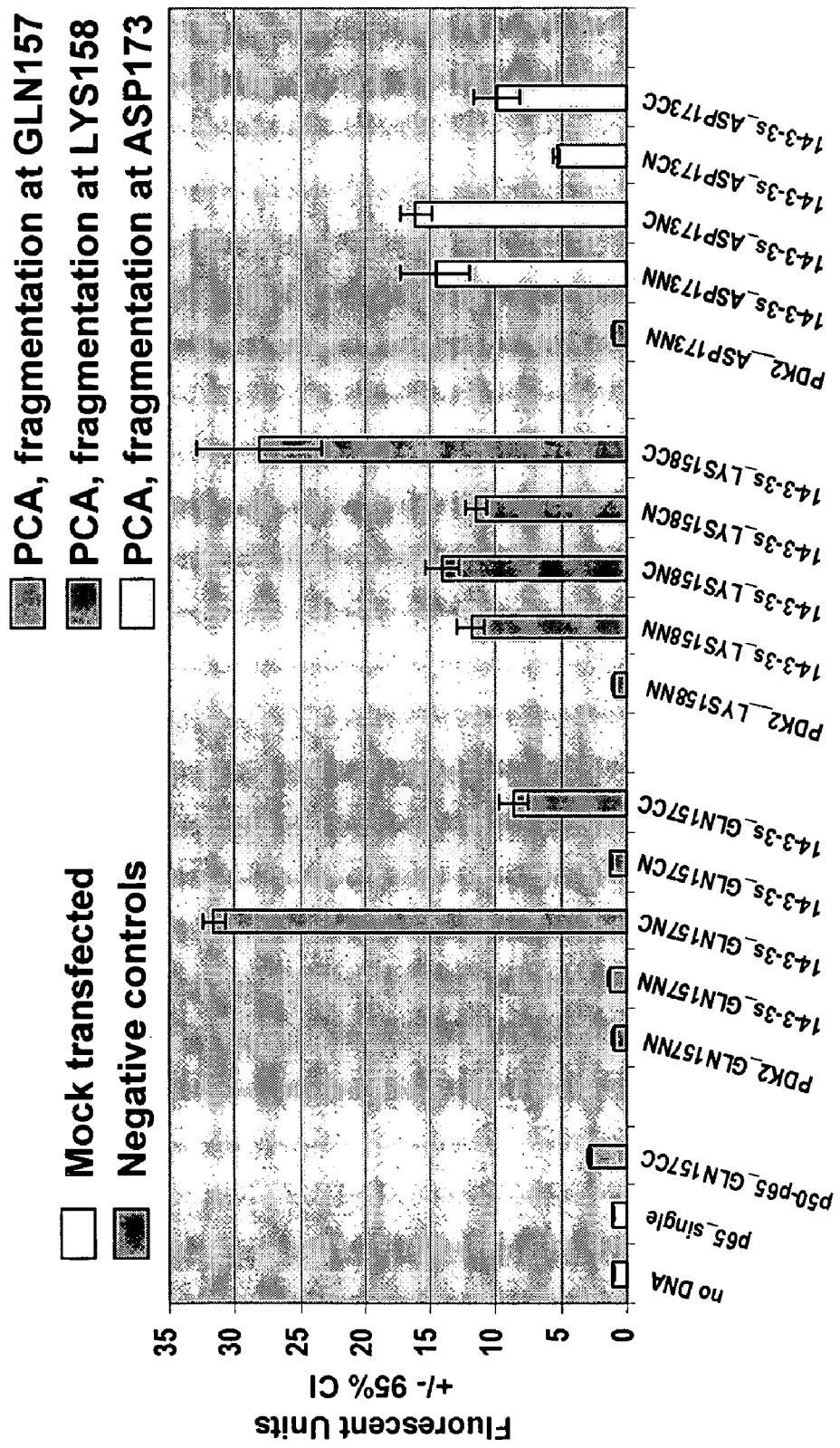
FIG. 4 shows PCAs based on fragment pairs generated from several alternative fragmentation sites as depicted in FIGS. 1a and 1b.

Based on these criteria the optimal fragmentation regions are shown in FIG. 1a relative to the linear model of the GFP structure. Fragmentation can be effected in one of the loops comprising amino acid residues 38–40 (region 1); amino acids 101–103 (region 2); amino acids 114–118 (region 3); amino acids 154–160 (region 4); amino acids 171–175 (region 5); or amino acids 188–190 (region 6). Fragmentation can be effected at one of the amino acids within those regions. It will be obvious to one skilled in the art that the exact residue at which the fragmentation is effected may vary within the designated loops without having a significant impact on the ability of the fragments to fold and reconstitute an active structure, as long as the design criteria described above and in U.S. Pat. No. 6,270,964 are followed. To prove the design principle, we present examples (FIG. 4) of successful PCA construction based on fragmentation of YFP at three different amino acids selected from the regions listed above.

While fragmentation of proteins for PCA is generally based on rational dissection of the polypeptide chain as described in the present invention, a number of other engineering approaches can be used that will be well known to one skilled in the art. For example, we have previously proposed an alternative approach based on the use of 5' exonucleases to generate libraries of fragments to search for optimal pairs (Michnick, et al. U.S. Pat. No. 6,270,964).

Figure 9:
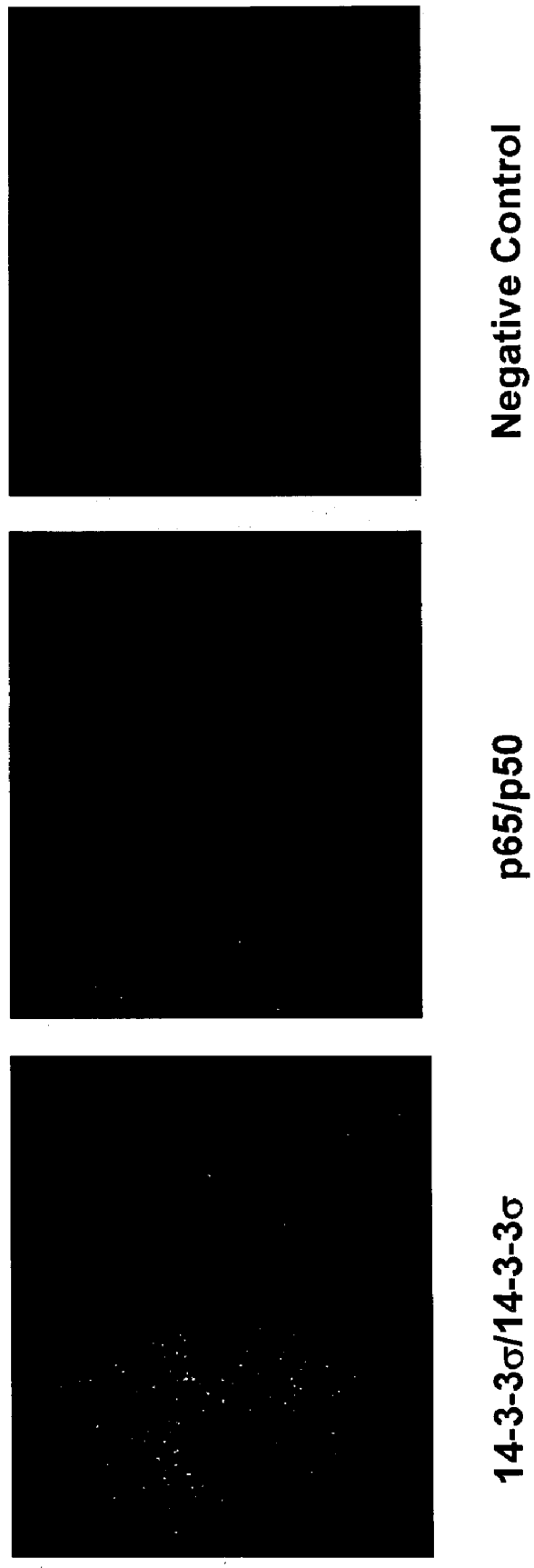
FIG. 9 demonstrates a spectrally shifted PCA based on mutant fluorescent protein fragments generating a blue signal in the presence of a protein-protein interaction FIG. 10 demonstrates multi-color PCA, wherein a single fusion protein (p65 in this example) tagged with a fragment corresponding to the C-terminus of a fluorescent protein is capable of generating two different fluorescent PCAs in the same cell depending upon the amino acid sequence of the reporter fragment fused to the proteins that interact with the first protein. Multi-color PCAs allow for the detection and quantification of different protein-protein complexes within the same cells.

In the present invention we generated fragments of the full-length cDNA for GFP using PCR to amplify fragments of interest. Alternatively, oligonucleotides encoding fragments can simply be synthesized using standard oligonucleotide synthesis techniques; this approach was taken to generate a PCA based on a cyan fluorescent protein (FIG. 9). In a preferred embodiment, mutant fragments of a fluorescent protein are used, having properties tailored to the biological application and the instrumentation to be used. To generate mutant fragments, as described below in detail, we utilized site-directed mutagenesis of GFP in order to obtain fragments that when reconstituted would have altered fluorescence properties or superior folding or maturation rates and stabilities. Site-directed mutagenesis is achieved by any of a number of approaches that are well known to one skilled in the art (see MM Ling & BH Robinson, 1997, Approaches to DNA mutagenesis: an overview. Anal Biochem 254: 157–78). Selected examples of such methods are provided here; however, these examples are not intended to be limiting for the practice of this invention. Suitable methods could include combinations of random mutagenesis and directed evolution or DNA shuffling schemes (A. L. Kurtzman et al., 2001, Advances in directed protein evolution by recursive genetic recombination: applications to therapeutic proteins, Curr Opin Biotechnol 2001 August;12(4):361–70; S W Santoro et al., 2002, Directed evolution of the site specificity of Cre recombinase. Proc Natl Acad Sci USA 2002 99:4185–90; Z. Shao et al., 1996, Engineering new functions and altering existing functions, Curr Opin Struct Biol 6:513–8; S. Harayama, 1998, Artificial evolution by DNA shuffling, Trends Biotechnol 1998, 16:76–82); assembly PCR or gene synthesis approaches (WP Stemmer et al., 1995, Single-step assembly of a gene and entire plasmid from large numbers of oligodeoxyribonucleotides, Gene 164(1):49–53; RM Horton et al. 1993, Gene splicing by overlap extension. Methods Enzymol. 217:270–9), or fragmentation by exo- or endo-nuclease digestion (M. Kitabatake and H. Inokuchi, 1993, A simplified method for generating step-wise deletions using PCR, Gene 123:59–61; S. Henikoff, 1990, Ordered deletions for DNA sequencing and in vitro mutagenesis by polymerase extension and exonuclease III gapping of circular templates, Nucleic Acids Res 18(10):2961–6). A particularly powerful method is based on 5'-template-assisted long-range plasmid polymerization as exemplified by a number of commercial mutagenesis kits, for example the QuickChange™ system (Stratagene). In addition, various forms of directed evolution based on DNA shuffling could also be used to generate completely novel PCAs.

Once the DNA fragments F1 and F2 of the gene encoding the fluorescent protein are generated, each fragment is individually fused in frame with a gene encoding a protein or polypeptide of interest in a suitable expression vector. A variety of standard and novel expression vectors can be chosen based on the cell type and desired expression level; such vectors and their characteristics will be well known to one skilled in the art. Optimally, a flexible linker, such as that described in Example 1 below, is fused between the fluorescent protein fragment and the gene of interest to facilitate fragment complementation. Therefore, each expression vector codes for a fusion protein consisting of an operably linked gene of interest, a flexible linker, and either F1 or F2 of the chosen fluorescent protein. As shown in FIG. 2, since either F1 or F2 can be fused to the gene of interest and the orientation of the fusion can be either 5' or 3' relative to the gene of interest, four different DNA constructs are possible for any single gene of interest. (It should be noted that if the fluorescent protein fragment is at the 5' end of the construct, it will be preceded by an initiating methionine (atg codon), whereas if the fragment is at the 3' end of the construct, the gene of interest will be preceded by the initiating methionine (atg codon)). Therefore, the invention covers not only F1 fragments that have a naturally occurring initiating methionine, but also the same F1 fragments that have been modified to remove the initiating methionine when the F1 fragment is to be at the 3' end of the construct. Similarly, the invention covers F2 fragments that naturally do not begin with an initiating methionine, but also those same F2 fragments that have been modified include an initiating methionine when the F2 fragment is to be at the 5' end of the construct.

To generate the PCA for a pair of proteins A and B, constructs encoding A and B fused separately to complementary fluorescent protein fragments F1 and F2 are co-transfected into cells. If proteins A and B interact, fragments F1 and F2 are brought into close proximity where they are capable of folding and reconstituting an active chromophore. The fluorescent signal can then be measured by a variety of standard methods, including fluorescence spectroscopy, flow cytometry (FACS), or microscopy. All of these methods can be used in automated, high-throughput formats using instrumentation well known to those skilled in the art. As described below, novel multicolor fluorescent PCAs can also be generated by using more than two construct pairs simultaneously. Finally, although it is expedient to carry out the engineering and construction of PCAs at the DNA level and then either allow a cell to produce the fusion proteins, it is not essential. For example, fusion proteins can be made in vitro using in vitro expression techniques that are well known to those skilled in the art. In addition, for in vitro PCAs, fusion polypeptides could be produced synthetically by peptide synthesis, or by ligation of peptide fragments encoding molecules of interest to create peptide fusions with the fluorescent protein fragments.

The structural homology amongst fluorescent proteins from various marine organisms enables the same design criteria described for GFP to be applied to other fluorescent proteins such as those recently described from Discosoma and from Anemonia. Therefore, in addition to GFP variants we present additional PCAs based on fragments of the monomerized Red Fluorescent Protein (mRFP1, derived from DsRed); and a fluorescent protein KFP1 that can be transiently activated (kindled) by irradiation of the chromophore at specific wavelengths based on the fluorescent protein 'asCP' from *Anemonia sulcata*. (Chudakov, D. M., Belousov, et al. 2003, Nat Biotechnol 21, 191–194). In both cases the fluorescent proteins are homologues of GFP at the amino acid level.

The red-shifted fluorescent PCAs that are the subject of this invention will be particularly useful for biological applications in which there is significant auto-fluorescence in the green channel. For example, red-shifted PCAs will be particularly useful for cDNA library screening applications using flow sorting. in this case the positive cell population expressing a protein-protein complex detected by an RFP PCA will be shifted away from the background population, readily allowing flow sorting of the positive cells.

DsRed from Discosoma has been demonstrated to be a structural homologue of GFP. DsRed is a 28-kDa polypeptide that has essentially the same chromophore as GFP, which is auto-catalytically formed from an internal Gln-Tyr-Gly (residues 66–68) tripeptide. DsRed is remarkably similar structurally to *A. victoria* GFP. In fact, the overall fold of DsRed is virtually identical to GFP, consisting of a slightly irregular 11-stranded beta-barrel (described as a beta can) with a coaxial central helix and alpha-helical caps on the barrel ends. The novel fragments that are the subject of this invention are based directly on examining of the RFP structure (Wall, M. A., et al., The structural basis for red fluorescence in the tetrameric GFP homolog DsRed, Nat Struct Biol 7, 1133–1138 (2000)) and using the rational design criteria described above for fragmentation of GFP. The amino acid sequence of mRFP1 is shown in Table 5 aligned with the sequence of *A. Victoria* GFP, showing alignment of the alternative fragmentation sites. The present invention encompasses nucleic acid sequences and polypeptide fragments generated by fragmentation of MRFP1 at the following alternative fragmentation sites: amino acids 38–40 (region 1); amino acids 100–102 (region 2); amino acids 113–117 (region 3); amino acids 152–156 (region 4); amino acids 167–171 (region 5); amino acids 182–184 (region 6). The positions of specific amino acid residues are shown for Glutamate 39 (E39), Aspartate 101 (D101), Aspartate 115 (D115), Glutamate 153 (E153), Aspartate 169 (D169), or Lysine 184 (K184). The fragmentation sites relative to the nucleic acid sequence encoding the full-length mRFP1 polypeptide are depicted in Table 6.

TABLE 4

Multiple alignment of coral (*Anthozoa* sp.) fluorescent proteins. The numbering is based on *A. victoria* GFP (M.V. Matz et al., Nature Biotech. 17: 969–973, 1999). Two proteins from Zoanthus and two from Discosoma are compared pairwise. Introduced gaps are represented by dots. In the consensus sequences ("cns") "O" marks an aromatic residue (Phe, Tyr, Trp, His); "@" = bulky hydrophobic residues (Val, Leu, Ile, Met, Phe, Trp); "+" = positively charged residues (His, Arg, Lys); "−" = negatively charged residues (Asp, Glu). "FP', fluorescent protein; 'z', Zoanthus; 'ds', Discosoma; 'dr', Discosoma 'red'; 'c', Clavularia; 'cns', consensus. DrFP583 is commonly referred to as 'DsRed' where 583 refers to the emission maximum at 583 nm (at an excitation maximum of 558 nm). By homology to the fragmentation sites chosen for GFP (FIG. 1A and 1B), alternative fragmentation sites of the coral fluorescent proteins which are the subject of the current invention are underlined.

```
         10        20        30        40        50
MSKGEELFTG.VVPILVELDGDVNGHKFSVSGEGEGDATYGKLTLKFICTT.GKLPVP..W    GFP       (SEQ ID NO:2)

MAQSKHGLTK.FMTMKYRMEGCVDGHKFVITGEGIGYPFKGKQAINLCVV..EGGPLPFAE    zFP506    (SEQ ID NO:9)

MAHSKHGLKE.EMTMKYHMEGCVNGHKFVITGEGIGYPFKGKQTINLCVI..EGGPLPFSE    zFP538    (SEQ ID NO:10)

MSCSKSVIKE.EMLIDLHLEGTFNGHYFFIKGKGKGQPNEGTNTVTLEVT  KGGPLPFGW    dsFP483   (SEQ ID NO:11)

MRSSKNVIKE.FMRFKVRMEGTVNGHEFFIEGEGEGRPYEGHNTVKLKVT..KGGPLPFAW    drFP583   (SEQ ID NO:12)

MALSNKFIGD.DMKMTYHMDGCVNGHYFTVKGEGNGKPYEGTQTSTFKVTMANGGPLAFSF    amFP486   (SEQ ID NO:13)

KALTTMGVIKPDMKIKLKMEGNVNGHAFVIEGEGEGKPYDGTHTLNLEVKMAEGAPLPFSY    cFP484    (SEQ ID NO:14)

MSKGEELFTG.VVPILVELDGDVNGHKFSVSGEGEGDATYGKLTLKFICTT.GKLPVP..W    GFP

MAQSKHGLTK.FMTMKYRMEGCVDGHKFVITGEGIGYPFKGKQAINLCVV..EGGPLPFAE    zFP506

MAHSKHGLKE.EMTMKYHMEGCVNGHKFVITGEGIGYPFKGKQTINLCVI..EGGPLPFSE    zFP538

MSCSKSVIKE.EMLIDLHLEGTFNGHYFFIKGKGKGQPNEGTNTVTLEVT  KGGPLPFGW    dsFP483

MRSSKNVIKE.FMRFKVRMEGTVNGHEFFIEGEGEGRPYEGHNTVKLKVT..KGGPLPFAW    drFP583

MALSNKFIGD.DMKMTYHMDGCVNGHYFTVKGEGNGKPYEGTQTSTFKVTMANGGPLAFSF    amFP486
```

TABLE 4-continued

Multiple alignment of coral (*Anthozoa* sp.) fluorescent proteins. The numbering is based on *A. victoria* GFP (M.V. Matz et al., Nature Biotech. 17: 969–973, 1999). Two proteins from Zoanthus and two from Discosoma are compared pairwise. Introduced gaps are represented by dots. In the consensus sequences ("cns") "O" marks an aromatic residue (Phe, Tyr, Trp, His); "@" = bulky hydrophobic residues (Val, Leu, Ile, Met, Phe, Trp); "+" = positively charged residues (His, Arg, Lys); "−" = negatively charged residues (Asp, Glu). "FP", fluorescent protein; 'z', Zoanthus; 'ds', Discosoma; 'dr', Discosoma 'red'; 'c', Clavularia; 'cns', consensus. DrFP583 is commonly referred to as 'DsRed' where 583 refers to the emission maximum at 583 nm (at an excitation maximum of 558 nm). By homology to the fragmentation sites chosen for GFP (FIG. 1A and 1B), alternative fragmentation sites of the coral fluorescent proteins which are the subject of the current invention are underlined.

```
KALTTMGVIKPDMKIKLKMEGNVNGHAFVIEGEGEGKPYDGTHTLNLEVKMAEGAPLPFSY   cFP484 s        M  @      EG vnGH F @ GeG G Po G   t@ @ V    GgPLpF    cns. Anthozoa

@  @      EG vnGH F @ GeG G    G   t@ @          P@p   cns. all 60        70        80        90       100       110
PTLVTTFSYGVQCFSRYPDHMKQHDFFKSAMPEGYVQERTIFFKDDGNYKTRAEVKFEGD..   GFP DILSAAFNYGNRVFTEYPQDIV..DYFKNSCPAGYTWDRSFLFEDGAVCICNADITVSVEEN   zFP506

DILSAGFKYGDRIFTEYPQDIV..DYFKNSCPAGYTWGRSFLFEDGAVCICNVDITVSVKEN   zFP538

HILCPQFQYGNKAFVHHPDNIH..DYLKLSFPEGYTWERSMHFEDGGLCCITNDISLTGN..   dsFP483

DILSPQFQYGSKVYVKHPADIP..DYKKLSFPEGFKWERVMNFEDGGVVTVTQDSSLQDG..   dsFP583

DILSTVFKYGNRCFTAYPTSMP..DYFKQAFPDGMSYERTFTYEDGGVATASWEISLKGN..   amFP486

DILSNAFQYGNRALTKYPDDIA..DYFKQSFPEGYSWERTMTFEDKGIVKVKSDISMEED..   cFP484 dILs   F YGn+  f  yP  @    DYfK sfPeGo wER @ OEDgq@      Dis@___   cns. Anthozoa iL   F YG     f  yP  @    DyfK   PeGo  ER @ O_D g      D@  @___   cns. all 120       130       140       150       160       170
TLVNRIELKGIDFKEDGNILGHKLEYNYNSHNVYIMADKQKNGIKVNFKIRHNIEDGSVQL    GFP CMYHESKFYGVNFPADGPVM.KKMTDNWEPSCEKIIPVPKQGILKGDVSMYLLLKDGGRLR    zFP506

CIYHKSIFNGMNFPADGPVM.KKMTTNWEASCEKIMPVPKQGILKGDVSMYLLLKDGGRYR    zFP538

CFYYDIKFTGLNFPPNGPVV.QKKTTGWEPSTERLYP..RDGVLIGDIHHALTVEGGGHYA    dsFP483

CFIYKVKFIGVNFPSDGPVM.QKKTMGWEASTERLYP..RDGVLKGEIHKALKLKDGGHYL    drFP583

CFEHKSTFHGVNFPADGPVM.AKKTTGWDPSFEKMTV..CDGILKGDVTAFLMLQGGGNYR    amFP486

SFIYEIRFDGMNFPPNGPVM.QKKTLKWEPSTEIMYV..RDGVLVGDISHSLLLEGGGHYR    cFP484 c@ O   f G@NFP dGPVm KkT WepS E+@    dG@L+GD@     L l GG+y      cns. Anthozoa

@    @ G@nF dG @@ K    o      @   ____@ @+     @  G           cns. all 180       190       200       210       220       230
ADHYQQNTPIGDG.PVLLPDNHYLSTQSALSKDPNEKRDHMVLLEFVTAAGITHGMDELYK    GFP CQFDTVYKAKSV..PRKMPDWHFIQHKLTREDRSDAKNQKWHLTEHAIASGSALP           zFP506

CQFDTVYKAKSV..PSKMPEWHFIQHKLLREDRSDAKNQKWQLTEHAIAFPSALA           zFP538

CDIKTVYRAKKA..ALKMPGYHYVDTKLVIWNNDKEFM.KVEEHEIAVARHHPFYEPKKDK    dsFP483

VEFKSIYMAKKA..PVQLPGYYYVDSKLDITSHNEDYT.IVEQYERTEGRHHLFL           drFP583

CQFHTSYKTKK...PVTMPPNHVVEHRIARTDLDKGGN.SVQLTEHAVAHITSVVPF         amFP486

CDFKSIYKAKK...VVKLPDYHFVDHRIEILNHDKDYN.KVTLYENAVARYSLLPSQA        cFP484 c @ t@Ykakk_ pvk@P ho@Dh+@       @ l E  a@a                     cns. Anthozoa

___    p @P ho@             @ l E   a                     cns. all
```

TABLE 5

Amino acid alignment of mRFP1 (SEQ ID NO:16) with
*A. victoria* GFP (SEQ ID NO:2) showing alternative
fragmentation Bites (underlined) that are the subject
of the present invention

```
# Aligned sequences:      2
# 1:                      A. victoria GET
# 2:                      mRPP1
# Matrix:                 EBLOSUM62
# Gap penalty:            12
# Extend penalty:         2

# Length:                 240
# Identity:               58/240 (24.2%)
# Similarity:             109/240 (45.4%)
# Gaps:                   17/240 (7.1%)
# Score:                  186
```

```
              10         20         30         40         50
GFP     MSKGEELFTGVVPILVELDGDVNGHKFSVSGEGEGDATYGKLTLKFICTT
        :...:...  . :...:.::::::.:...:::: : : :. :
mRFP1   MASSEDVIKEFMRFKVRMEGSVNGHEFEIEGEGEGRPYEGTQTAKLKVTK
              10         20         30         40         50

60         70         80         90
GFP     G-KLPVPWPTLVTTFSYGVQCFSRYPDHMKRHDFFKSAMPEGYVQERTIF
        : ::  :  :   :.::  ...  ..:  .   :..:  ..:::.  ::..
mRFP1   GGPLPFAWDILSPQFQYGSKAYVKHPADIP--DYKLSFPEGFKWERVMN
              60         70         80         90

100        110        120        130        140
GFP     FKDDGNYKTRAEVKFEGDTLVNRIELKGIDFKEDGNILGHK-LEYNYNSH
        :.: :   .  . ...  .. ...:.: .:  .:: ..  :  .. ...
mRFP1   FEDGGVVTVTQDSSLQDGEFIYKVKLRGTNFPSDGPVMQKKTMGWEASTE
             100        110        120        130        140

150        160        170        180        190
GFP     NVYIMADKQKNGIKVNFKIRHNIEDGSVQLADHYQQNTPIGDGPVLLPDN
        ..:    . ...:  ..:.:  ...::.   :.     ..:  ..  :: ::
mRFP1   RMY----PEDGALKGEIKMRLKLKDGGHYDAE--VKTTYMAKKPVQLPGA
             150        160        170        180        190

200        210        220        230
GFP     HYLSTQSALSKDPNEKRDHMVLLEFVTAAGITHGMDELYK
        .  . ..   ....:..:.. ..   :    .:.  .
mRFP1   YKTDIKLDIT---SHNEDYTIVEQYERA----EGRHSTGA
             200        210        220
```

TABLE 6 mRFP1 full length nucleic acid (SEQ ID NO:15) and amino acid sequence (SEQ ID NO:16).
Alternative fragmentation sites that are the subject of the present invention are
shown at the following regions (underlined): amino acids 38–40 (region 1); amino
acids 100–102 (region 2); amino acids 152–156 (region 3); amino acids 167–171 (region
4); amino acids 182–191 (region 5). The positions of specific amino acid residues at
the fragmentation sites for mRFP1 are shown for Glutamate 39 (E39), Aspartate 101
(D101), Aspartate 115 (D115), Glutamate 153 (E153), Aspartate 169 (D169), or Lysine
184. (K184)

```
atg gcc tcc tcc gag gac gtc atc aag gag ttc atg cgc ttc aag gtg cgc atg gag ggc
 M   A   S   S   E   D   V   I   K   E   F   M   R   F   K   V   R   M   E   G
 1           5                  10                  15                  20 tcc gtg aac ggc cac gag ttc gag atc gag ggc gag ggc gag ggc cgc ccc tac gag ggc
 S   V   N   G   H   E   F   E   I   E   G   E   G   E   G   R   P   Y   E   G
 21                  25                  30                  35         E39  40 acc cag acc gcc aag ctg aag gtg acc aag ggc ggc ccc ctg ccc ttc gcc tgg gac atc   T   Q
 T   A   K   L   K   V   T   K   G   G   P   L   P   F   A   W   D   I
 41                  45                  50                  55                  60 ctg tcc cct cag ttc cag tac ggc tcc aag gcc tac gtg aag cac ccc gcc gac atc ccc
 L   S   P   Q   F   Q   Y   G   S   K   A   Y   V   K   H   P   A   D   I   P
 61                  65                  70                  75                  80
```

TABLE 6-continued mRFP1 full length nucleic acid (SEQ ID NO:15) and amino acid sequence (SEQ ID NO:16). Alternative fragmentation sites that are the subject of the present invention are shown at the following regions (underlined): amino acids 38–40 (region 1); amino acids 100–102 (region 2); amino acids 152–156 (region 3); amino acids 167–171 (region 4); amino acids 182–191 (region 5). The positions of specific amino acid residues at the fragmentation sites for mRFP1 are shown for Glutamate 39 (E39), Aspartate 101 (D101), Aspartate 115 (D115), Glutamate 153 (E153), Aspartate 169 (D169), or Lysine 184. (K184)

```
gac tac ttg aag ctg tcc ttc ccc gag ggc ttc aag tgg gag cgc gtg atg aac ttc gca     D
 Y   L   K   L   S   F   P   E   G   F   K   W   E   R   V   M   N   F   E
 81          85              90              95              100 gac ggc ggc gtg gtg acc gtg acc cag gac tcc tcc ctg cag gac ggc gag ttc atc tac
 D   G   G   V   V   T   V   T   Q   D   S   S   L   Q   D   G   E   F   I   Y
D101         105             110             D115            120 aag gtg aag ctg cgc ggc acc aac ttc ccc tcc gac ggc ccc gta atg cag aag aag acc    K
 V   K   L   R   G   T   N   F   P   S   D   G   P   V   M   Q   K   K   T
121         125             130             135             140 atg ggc tgg gag gcc tcc acc gag cgg atg tac ccc gag gac ggc gcc ctg aag ggc gag
 M   G   W   E   A   S   T   E   R   M   Y   P   E   D   G   A   L   K   G   E
141         145             150             E153            155             160 atc aag atg agg ctg aag ctg aag gac ggc ggc cac tac gac gcc gag gtc aag acc acc
 I   K   M   R   L   K   L   K   D   G   G   H   Y   D   A   E   V   K   T   T
161         165             D169 170                175             180 tac atggccaag aag ccc gtg cag ctg ccc ggc_gcc tac aag acc gac atc aag ctg gac
 Y   M   A   K   K   P   V   Q   L   P   G   A   Y   K   T   D   I   K   L   D
181         K184 185             190             195             200 atc acc tcc cac aac gag gac tac acc atc gtg gaa cag tac gag cgc gcc gag ggc cgc   I   T
 S   H   N   E   D   Y   T   I   V   E   Q   Y   E   R   A   E   G   R
201         205             210             215             220 cac tcc acc ggc gcc
 H   S   T   G   A
221         225
```

A PCA based on kindling fluorescent protein (KFP1) is also the subject of the present invention. In the case of KFP1, which is a variant of the fluorescent protein derived from Anemonia sulcata, the alternative fragmentation sites are based on the alignment of KFP1 to GFP as shown in Table 7. Table 8 shows the fragmentation sites relative to the full-length nucleotide and amino acid sequence of KFP1.

TABLE 7

Amino acid alignment of kindling fluorescent protein (KFP1) (SEQ ID NO:18) with *A. victoria* GFP (SEQ ID NO: 2), showing alternative fragmentation sites (underlined) that are the subject of the present invention

```

# Aligned sequences: 2
# 1:              A. victoria GFP
# 2:              kindling fluorescent protein (KFP1)
# Matrix:         EBLOSUM62
# Gap penalty:    12
# Extend penalty: 2

# Length:         241
# Identity:       57/241 (23.7%)
# Similarity:     98/241 (40.7%)
# Gaps:           12/241 ( 5.0%)
# Score:          145

10        20        30        40
GFP     MSKGEELFTGVVPILVELDGDVNGHKFSVSGEGEGDATYGKLTLKF-ICT
        :..    :.: ...:. . ..: :::: :. :.:::   :    .:. .
```

TABLE 7-continued

Amino acid alignment of kindling fluorescent protein (KFP1) (SEQ ID NO:18) with *A. victoria* GFP (SEQ ID NO: 2), showing alternative fragmentation sites (underlined) that are the subject of the present invention

```
KFP1    MAS---LLTETMPFKTTIEGTVNGHCFKCIGKGEGNPFEGTQEMKIEVIE
                 10        20        30        40

50        60        70        80        90
GFP     TGKLPVPWPTLVTTFSYGVQCFSRYPDHMKRHDFFKSAMPEGYVQERTIF
        : ::   .  : :.   ::  . : .: . .   :.::...:::.. :::
KFP1    GGPLPFAFHILSTSCMYGSKTFIKYVSGIP--DYFKQSFPEGPTWERTTT
             50        60        70          80        90

100       110       120       130       140
GFP     FKDDGNYKTRAEVKFEGDTLVNRIELKGIDFKEDGNILGHKLEYNYNSHN
        ..:  :   ..  .....::  ::  .... :  .:   ::  .. .:.     . .
KFP1    YEDGGFLTAHQDTSLDGDCLVYKVKILGNNFPADGPVMQNKVGRWEPGTE
             100       110       120       130       140

150       160       170       180       190
GFP     VYIMADKQKNGIKVNFKIRHNIEDGSVQLADHYQQNTPIG--DGPVLLPD
        .     .:  ..  .:    : .      :... :.    :  .
KFP1    IVYEVDGVLRGQSLMALKCPGGRHLTCHLHTTYRSKKPASALKMPGPHFE
             150       160       170       180       190

200       210       220       230
GFP     NHYLSTQSALSKDPNEKRDHMVLLEFVTAAGITHGMDELYK
        .:  ..  .. ..:    :.   ..  ::      :      ..
KFP1    DHRIEIMEEVEKGKCYKQYEAAVGRYCDAAPSKLG----HN
             200       210       220       230
```

TABLE 8

Kindling fluorescent protein (KFP1) full length nucleic acid (SEQ ID NO: 17) and amino acid sequence (SEQ ID NO:18). Alternative fragmentation sites that are the subject of the present invention are shown at the underlined regions: residues 35–37 (region 1); residues 97–99 (region 2); residues 110–114 (region 3); residues 150–156 (region 4); residues 167–171 (region 5); residues 184–195 (region 6). The positions of specific amino acid residues at the fragmentation sites for KFP1 are shown for Glutamate 36 (E36), Aspartate 98 (D98), Glycine 112 (G112), Valine 153 (V153), Histidine 169 (H169), or Alanine 186 (A186).

```
atg gcc tcc ctg ctg aca gag acc atg ccc ttc aag acc acc atc gag ggc acc gtg aac
 M   A   S   L   L   T   E   T   M   P   F   K   T   T   I   E   G   T   V   N
 1           5                  10                  15                      20 ggc cac tgc ttc aag tgc atc ggc aag ggc gag ggc aac ccc ttc gag ggc acc cag gag
 G   H   C   F   K   C   I   G   K   G   E   G   N   P   F   E   G   T   Q   E
             25                  30                   35  E36              40 atg aag atc gag gtg atc gag ggc ggc ccc ctg ccc ttc gcc ttc cac atc ctg tcc acc
 M   K   I   E   V   I   E   G   G   P   L   P   F   A   F   H   I   L   S   T
                 45                  50                  55                  60 tcc tgc atg tac ggc tcc aag acc ttc atc aag tac gtg tcc ggc atc ccc gac tac ttc
 S   C   M   Y   G   S   K   T   F   I   K   Y   V   S   G   I   P   D   Y   F
                 65                  70                  75                  80 aag cag tcc ttc ccc gag ggc ttc acc tgg gag cgc acc acc acc tac gag gac ggc ggc
 K   Q   S   F   P   E   G   F   T   W   E   R   T   T   T   Y   E   D   G   G
                 85                  90                  95      D98        100 ttc ctg acc gcc cac cag gac acc tcc ctg gac ggc gac tgc ctg gtg tac aag gtg aag
 F   L   T   A   H   Q   D   T   S   L   D   G   D   C   L   V   Y   K   V   K
                105                 110  G112           115                 120 atc ctg ggt aac aac ttc ccc gcc gac ggc ccc gtg atg cag aac aag gtc ggc cgc tgg
 I   L   G   N   N   F   P   A   D   G   P   V   M   Q   N   K   V   G   R   W
                125                 130                 135                 140 gag ccc gga acc gag atc gtg tac gag gtg gac ggc gtg ctg cgc ggc cag tcc ctg atg
 E   P   G   T   E   I   V   Y   E   V   D   G   V   L   R   G   Q   S   L   M
                145                 150 V153            155                 160
```

TABLE 8-continued

Kindling fluorescent protein (KFP1) full length nucleic acid (SEQ ID NO: 17) and amino acid sequence (SEQ ID NO:18). Alternative fragmentation sites that are the subject of the present invention are shown at the underlined regions: residues 35–37 (region 1); residues 97–99 (region 2); residues 110–114 (region 3); residues 150–156 (region 4); residues 167–171 (region 5); residues 184–195 (region 6). The positions of specific amino acid residues at the fragmentation sites for KFP1 are shown for Glutamate 36 (E36), Aspartate 98 (D98), Glycine 112 (G112), Valine 153 (V153), Histidine 169 (H169), or Alanine 186 (A186).

```
gcc ctg aag tgc ccc ggc ggc cgg cac ctg acc tgc cac ctg cac acc acc tac cgc tcc
A   L   K   C   P   G   G   R   H   L   T   C   H   L   H   T   T   Y   R   S
                165             H169 170            175                     180 aag aag ccc gcc tcc gcc ctg aag atg ccc ggc ttc cac ttc gag gac cac cgc atc gag
K   K   P   A   S   A   L   K   M   P   G   F   H   F   E   D   H   R   I   E
                185 A186            190             195                     200 atc atg gag gag gtg gag aag ggc aag tgc tac aag cag tac gag gcc gcc gtg ggc cgc
I   M   E   E   V   E   K   G   K   C   Y   K   Q   Y   E   A   A   V   G   R
                205             210             215                         220 tac tgc gac gcc gcc ccc tcc aag ctg ggc cac aac
Y   C   D   A   A   P   S   K   L   G   H   N
                225             230
```

It is a feature of PCA that the reassembled fragments are capable of re-creating the activity of the intact reporter from which the fragments are derived. For example, for a PCA based on dihydrofolate reductase (DHFR), the reassembled fragments are capable of binding methotrexate in a manner similar to the full-length protein (I. Remy & S. W. Michnick, 1999, Proc Natl Acad Sci USA, 96: 5394–5399); in addition, mutations that affect the properties of the intact DHFR protein confer similar properties to the DHFR fragments when they are used in PCA (J. N. Pelletier, F.-X. C.-Valois & S. W. Michnick, 1998, *Proc Natl Acad Sci USA* 95: 12141–12146). Similarly, fragments of β-lactamase used in PCA are capable of cleavage of cephalosporin substrates with kinetics similar to the intact β-lactamase protein, and mutations that disrupt the molten globule structure of the intact protein improve the enyzymatic properties of the reassembled fragments (A. Galarneau, M. Primeau, L.-E. Trudeau & S. W. Michnick, 2000, Nature Biotechnol. 20: 619–622).

Since the spectral properties of fluorescent proteins are critically dependent upon the orientation and proximity of amino acids relative to the core chromophore, it is not obvious that mutations that affect the spectral properties of an intact fluorescent protein would have the same effect when engineered into fragments of the protein. We reasoned that, if mutations that affect the spectral properties of fluorescent proteins could be engineered into protein-fragment complementation assays, it would be possible to generate a wide variety of PCAs with various spectral properties. Moreover, the availability of different color PCAs would enable the engineering of designer PCAs for a variety of applications in biology and biotechnology.

To demonstrate this principle, we created PCAs based on numerous variants of *A. victoria* green fluorescent protein and tested them by creating fusion constructs with several different human genes known to be involved in protein-protein interactions in mammalian cells. In the first example, fragments were generated for PCA by fragmenting an enhanced green fluorescent protein ("EGFP" in Table 3) in order to create a green fluorescent PCA (GFP PCA). The GFP fragments were then further mutated to create novel fragments having the mutations S65G/V68L/S72A/T203Y which corresponds to the yellow fluorescent protein (YFP) variant named "10C" in Table 2, also referred to as enhanced yellow fluorescent protein ("EYFP") as in Table 3. With intact GFP, the introduction of the S65G/V68US72A/T203Y mutations into results in a protein with excitation and emission maxima at 514 nm and 527 nm, respectively, in which the chromophore matures fourfold faster than for the wild type GFP, generating a bright signal for cell biology applications. We sought to determine whether this GFP variant could be used in PCA and to assess the relative intensities of this YFP PCA versus the GFP PCA in cells transiently co-transfected with fragments fused to full-length proteins that had been previously reported to interact in human cells; this analysis is described in detail in Example 1, below.

To demonstrate the utility of the various fragment pairs that are the subject of the invention, we selected three of the fragmentation sites depicted in FIG. 1b and constructed PCAs based on YFP fragments fused to known interacting proteins in various gene/fragment orientations (NN, NC, CN and CC). In Example 2, described below, the results showed that the different fragmentation sites could in fact be used to construct alternative PCAs with good signals vs. background.

In two further examples of the engineering of PCAs based on mutant fragments, we further mutated the YFP fragments in order to determine if mutations shown to enhance the brightness of full-length YFP at physiological temperatures would confer similar properties when engineered into fragments for PCA. First, we engineered two additional mutations, S64L and M153T into YFP[1]. Both the S64L and M153T mutations improve the folding of full-length green fluorescent protein (Tsien, Ann. Rev. Biochem.) and confer enhanced fluorescence to the intact, full-length protein (B P. Cormack et al., Gene 173: 33–38). These mutations are a component of the YFP variant known as SEYFP (see Table 3). In example 3, described in detail below, we directly compared a YFP PCA with the novel SEYFP PCA.

In yet another example of engineering mutant fragments for PCA, we introduced the mutation F46L into fragment 1 of SEYFP, generating novel fragment we designated IFP[1], and we introduced the mutations V163A and S175G into fragment 2 of YFP, generating novel fragment IFP[2]. These mutations are a component of the YFP variant known as SEYFP-F46L ('Venus') in Table 3. The results demonstrate the ability to engineer a highly intense fluorescent PCA (IFP PCA) by engineering mutant fragments of fluorescent proteins.

In a fourth example of the invention, we demonstrated the ability to create PCAs with specific desired spectral properties by creating mutant polypeptide fragments. We created a cyan fluorescent PCA (CFP PCA) by synthesizing fragments with mutations conferring a spectral shift to the blue region. This invention provides fragments for generating a wide spectrum of PCAs through genetic engineering including green, yellow, blue-green, blue, cyan, orange-red and red variants with various intensities and signal maturation characteristics.

In a final example of the invention, we demonstrated multi-color PCAs in which a single fragment of a fluorescent reporter generates different fluorescent colors within the same cell, depending upon the amino acid sequence of the fragment with which it is paired.

EXAMPLE 1

Creation of Fluorescent Protein-fragment Complementation Assays and the Generation of Mutant Fragments for PCA We sought to create two PCAs with different spectral properties starting with *A. victoria* GFP. First, GFP fragments were generated by PCR from a mammalian codon-optimized version of GFP (pCMS-EGFP; Clontech). GFP[1] corresponded to amino acids 1 to 158 and GFP[2] to amino acids 159 to 239 of GFP. Second, fragments encoding a yellow variant of GFP (YFP PCA) were created by introducing the EYFP-specific mutations S65G, S72A into fragment 1 of GFP and the mutation T203Y into fragment 2 of GFP by PCR, resulting in fragments YFP[1] and YFP[2], respectively.

The fragments GFP[1], GFP[2], YFP[1], and YFP[2] were subcloned into a mammalian expression vector (pcDNA3.1Z, Invitrogen), which had previously been modified to incorporate the replication origin (oriP) of the Epstein Barr virus (EBV). The oriP allows episomal replication of these modified vectors in cell lines expressing the EBNA1 gene, such as HEK293E cells (293-EBNA, Invitrogen). Additionally, these vectors still retain the SV40 origin, allowing for episomal expression in cell lines expressing the SV40 large T antigen (e.g. HEK293T, Jurkat or COS) as well.

To test the activity and relative signal intensity of the GFP PCA versus the engineered YFP PCA, PCAs were created for three pairs of proteins that have previously been shown to interact in mammalian cells. These included the self-interaction of the tumor suppressor protein p53 (N. D. Lakin & S. P. Jackson, Oncogene 18: 7644–7655, 1999); the interaction of the papillomavirus E6 protein with p53 (B. A. Werness, A. J. Levine & P. M. Howley, Science 248: 76–79, 1990); and the interaction of the E6 protein with E6AP, a protein that mediates the interaction of E6 with p53 (J. M. Huibregtse, M. Scheffner & P. M. Howley, Mol. Cell. Biol. 13: 775–784, 1993). The full coding sequence for p53, E6 and E6AP was amplified by PCR from a sequence-verified full-length cDNA. The resulting PCR products were cleaned up by vacuum filtration (MultiScreen PCR, Amicon), digested with appropriate restriction enzymes to allow directional cloning, and fused in-frame to either the 5' or 3'-end of GFP[1], YFP[1], GFP[2] or YFP[2] through a flexible linker encoding a 10-amino acid peptide (Gly.Gly.Gly.Gly.Ser)2 (SEQ ID NO:19). The use of a flexible linker between the gene of interest and the reporter fragment assures that the orientation and arrangement of the fusions is optimal to bring the fluorescent protein fragments into close proximity (J. N. Pelletier, F.-X. C.-Valois & S. W. Michnick, 1998, *Proc Natl Acad Sci USA* 95: 12141–12146). The orientations of the paired constructs was as follows: F1-linker-p53 with F2-linker-p53; F1-linker-E6 with E6AP-linker-F2; and F1-linker-E6 with F2-linker-p53, where F1 and F2 were the fragments of either GFP or YFP. DNAs from recombinant constructs were isolated using Qiagen Turbo BioRobot Prep kits (Qiagen, Chatsworth, Calif.) on a Beckman FX robotic workstation (Beckman Coulter, Fullerton, Calif.). Isolated DNAs were quantitated and then normalized to a concentration of 50 ng/µl.

Figure 3:
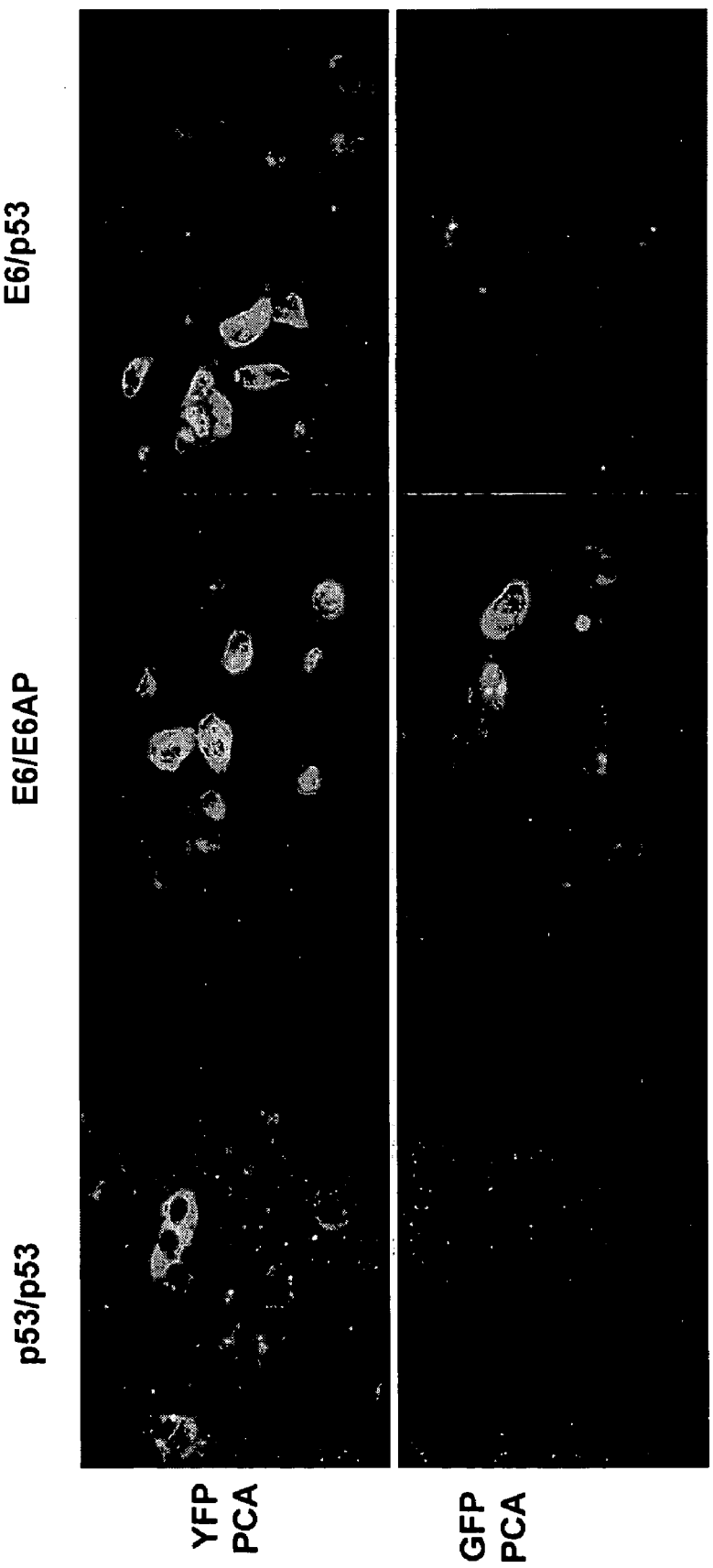
FIG. 3 shows photomicrographs of PCA results in live cells, depicting the relative fluorescent intensities achieved with PCAs based on two variants of A. victoria (GFP PCA and YFP PCA); several different protein-protein complexes were evaluated by fluorescence microscopy 24 hours after transient transfection.

Twenty-four hours prior to transfection, HEK293E cells were plated (20,000 cells per well) in 24-well plates coated with poly-lysine, then co-transfected with 0.5 micrograms of DNA using Fugene transfection reagent (Roche Diagnostics, Indianapolis, Ind.), as per the manufacturer's recommendations. Following 24 hrs of expression, cells were washed once with PBS and viewed on a Nikon TE-2000 microscope equipped with a HYQ-FITC filter cube (excitation: 460–500 nm; emission:505–560 nm; dichroic mirror: 505LP). Images were acquired with a CoolSnap HQ CCD camera. FIG. 3 shows the results of fluorescence microscopy of GFP PCA vs. YFP PCA for the interactions of p53/p53, E6/E6AP and E6/p53. The reconstituted GFP or YFP signal could clearly be seen, and the subcellular localization of the complexes could be determined consistent with their known localizations. However, the YFP PCA signal was visually brighter than the GFP PCA signal for all three protein-protein complexes, demonstrating that the YFP mutations previously shown to enhance the signal intensity of the full-length protein were also effective in enhancing the intensity of the reassembled fragments. Moreover, the excitation and emission maxima of the YFP PCA were nearly identical to that of the intact fluorescent protein YFP 10c (Table 2), suggesting that the complementary fragments are capable of folding and generating a chromophore with substantially the same properties as that generated by the intact protein.

EXAMPLE 2

Alternative Fragmentation Sites in Fluorescent Proteins

In order to demonstrate that fluorescent protein fragments generated from alternative fragmentation sites—that are the subject of the invention—could be used in PCA, fluorescent protein PCAs based were created for a yellow (YFP) fluorescent protein (see FIG. 4). cDNAs encoding full-length proteins (Pdk2, 14-3-3σ, and the components of the NFκB heterodimer p50 and p65) were fused to either the N- or C-terminus of complementary YFP fragments YFP[1] and YFP[2], corresponding to fragmentation of the full length protein at positions shown in FIG. 1*a* and FIG. 1*b* as Gln 157, Lys 158 or Asp 173, where the indicated amino acid residue represents the C-terminus of the N-terminal reporter fragment designated as YFP[1]. Formation of 14-3-3/14-3-3 dimers was used to assess the ability of each PCA fragment pair to allow for the detection of protein-protein complexes. Pdk2-YFP[1]/Pdk2-YFP[2] was used as a negative PCA control. HEK293E cells were transiently transfected with 100 ng of each construct pair, and total fluorescence was evaluated 48 hrs later on a Molecular Devices Gemini XS platereader. Each bar represents the mean fluorescence of triplicate measurements, with error bars representing 95% confidence limits. Mock-transfected cells (no DNA or a single DNA construct) are shown in yellow. Various fragment orientations and combinations were tested, since optimal detection of complex formation may be orientation-dependent. In this example, the Lys158 and Asp173 fragmentation sites allowed detection of 14-3-3/14-3-3 complexes in all possible fragment combinations. The Gln156 fragmentation site allowed detection of 14-3-3/14-3-3 complexes in both the NC and CC orientations. Fragment/gene orientations were as follows: NN=14-3-3-YFP[1]/14-3-3-YFP[2]; NC=14-3-3-YFP[1]/YFP[2]-14-3-3; CN=YFP[1]-14-3-3/14-3-3-YFP[2]; CC=YFP[1]-14-3-3/YFP[2]-14-3-3). The results demonstrate the utility of the protein engineering principles that are incorporated into this invention, showing that various fragment pairs are useful for PCA. The compositions that are the subject of the invention include various fragment pairs incorporating a wide range of mutations useful for PCA.

EXAMPLE 3

Mutant Fragments Generating a Super-enhanced YFP PCA (SEYFP-PCA) and an Intense Fluorescent PCA (IFP PCA) with Brighter Signals than YFP PCA for Biological Applications To further demonstrate that the spectral properties of a PCA can be influenced by engineering mutant fragments, we first engineered the F64L and M153T mutations of SEYFP into YFP[1] by PCR, creating novel fragment SEYFP[1]. Subcloning was performed as described for Example 1. Fusion constructs were prepared as described above, for the interacting protein kinases MEK and ERK. Specific mutations in each reporter fragment confirmed by sequencing are noted, and are designated relative to wtGFP as in Table 2 and 3.

For quantitative measurements of fluorescence intensity, each well of a 96-well poly-lysine coated plate was seeded with 15,000 HEK293E cells 24 hours prior to transfection. Cells were transfected with 100 ng of DNA in total per well with FuGene transfection reagent, using conditions recommended by the manufacturer. The amount of each fusion construct varied from 50 ng of each construct to as little as 0.1 ng of each construct, with the remaining DNA supplied by an empty 'carrier' vector (e.g. up to 98 ng of carrier DNA for 2 ng total of fusion construct DNA). All transfections were performed in triplicate. Twenty-four or forty-eight hours after transfection, the cells were stained with a 1:300 dilution of Hoescht 33342 (Molecular Probes, Eugene, Oreg.) for 10 minutes, then washed several times with Dulbecco's phosphate buffered saline, then overlaid with a small volume of Hank's Buffered Salt Solution. After a 90 minute incubation at 37° C., mean fluorescence intensity data for each well were acquired on a SpectraMax Gemini XS Plate reader (Molecular Devices), using an excitation wavelength of 485 nm, emission of 527 nm and cutoff of 515 nm. For each sample PCA, mean fluorescence intensity was calculated from triplicate measurements. Relative fold increase in fluorescence was determined by normalizing the mean fluorescence intensity for the test PCA to that of the negative control.

Figure 5:
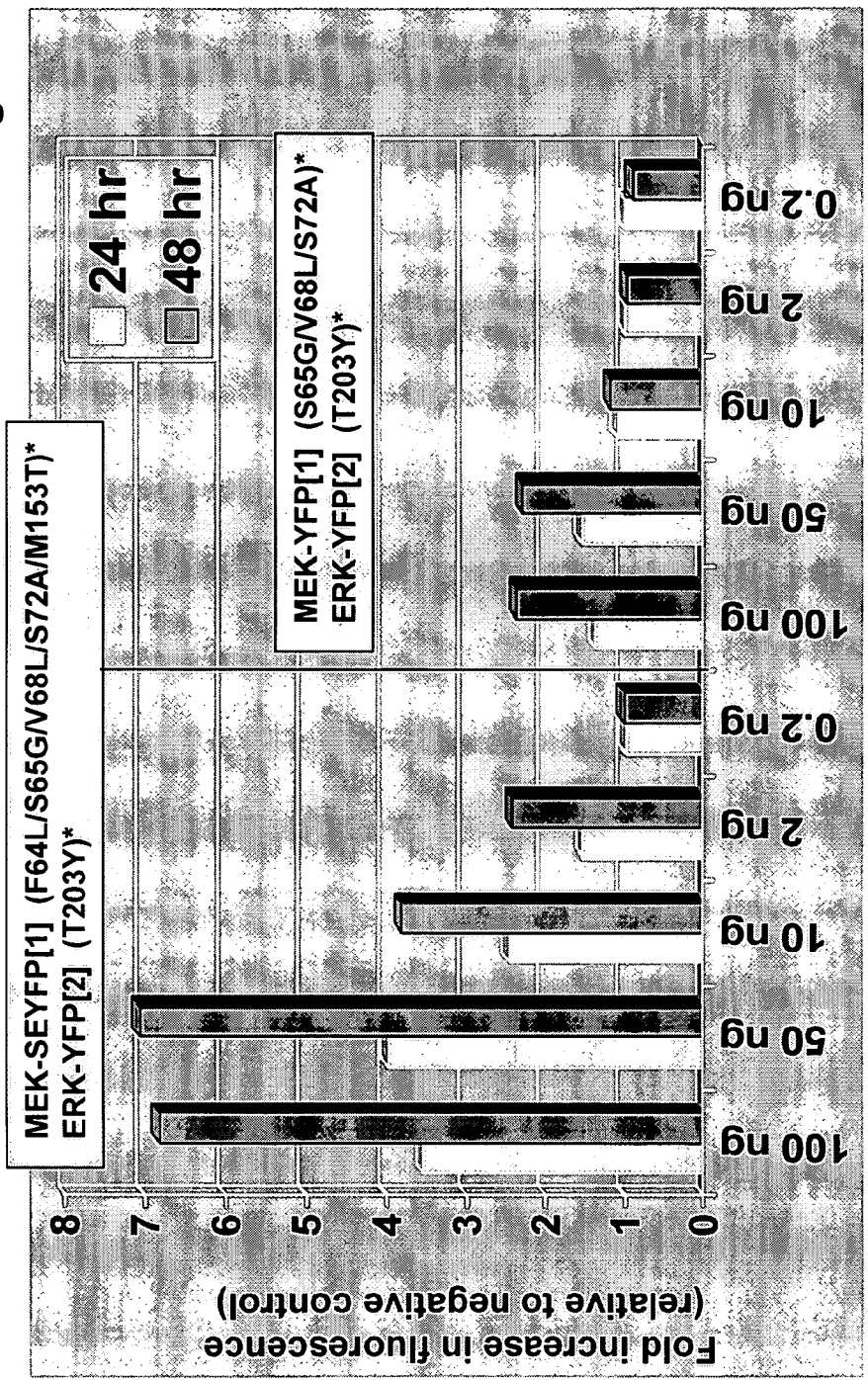
FIG. 5 shows that specific mutations enhance the fluorescent intensities of reassembled fragments, comparing two sequence variants of a YFP PCA that differ by two amino acids; the proteins fused to the complementary fragments are the protein kinases MEK and ERK.

As shown in FIG. 5, the MEK/ERK protein-protein complex could be detected with either of the two fluorescent PCAs. However, the use of SEYFP[1] (F64L and M153T) instead of YFP[1] enhanced the signal intensity two-to four-fold. With this particular mutant YFP PCA (left side of histogram), signal could be readily detected over background with only 2 ng total of 'test' DNA. Moreover, 10 ng DNA for the YFP PCA (right side of histogram) gave a barely detectable signal, whereas the equivalent DNA for the SEYFP PCA gave a signal nearly four times background (left side of histogram). The example demonstrates that mutations known to enhance the intensity of the intact protein confer a similar property on the reassembled fragments.

FIG. 6 shows fluorescence microscopy images of the same PCAs as in FIG. 5, demonstrating that the additional mutations of SEYFP[1] (panel a) enhance the signal intensity as detected by fluorescence microscopy, enabling improved discrimination of the subcellular location of the protein-protein complexes. HEK293E cells were transfected with 5 ng of each fusion construct (plus 90 ng carrier DNA). Images were acquired 48 hrs later using the Discovery-1 automated image acquisition system, using a 20 ms exposure time, and FITC filter set. Protein-protein complexes could also be readily visualized with the YFP PCA (panel b) but were less intense.

Since fragment 1 of these constructs contains all three of the amino acids that form the chromophore in the intact fluorescent protein, we also tested single mutant fragments YFP[1] and YFP[2] to ensure that individual fragments were incapable of generating a fluorescent signal. For panels c and d of FIG. 6, we transfected 50 ng of DNA from a single fusion construct with the indicated mutations. The left hand panel shows the fluorescence image; the right hand panel shows a DAPI stain of the cells, demonstrating that cells were present in the field that was imaged. Neither fragment alone, expressed as a fusion to protein Pdk2, gave a fluorescent signal. In subsequent analyses of over 6000 assays we found that under the experimental conditions we employed, the generation of a fluorescent PCA signal is dependent upon the interacting molecules. This is an important feature of the invention because it demonstrates that we are not tagging proteins with a fluorescent molecule. Rather, we are tagging proteins with polypeptide fragments which themselves are not fluorescent. The fluorescent signal is only generated upon interaction of the molecules to which the reporter fragments are fused. Interaction of the molecules of interest brings the reporter fragments into close proximity, allowing the fragments to fold together into an active structure capable of generating a fluorescent signal.

Figure 7A:
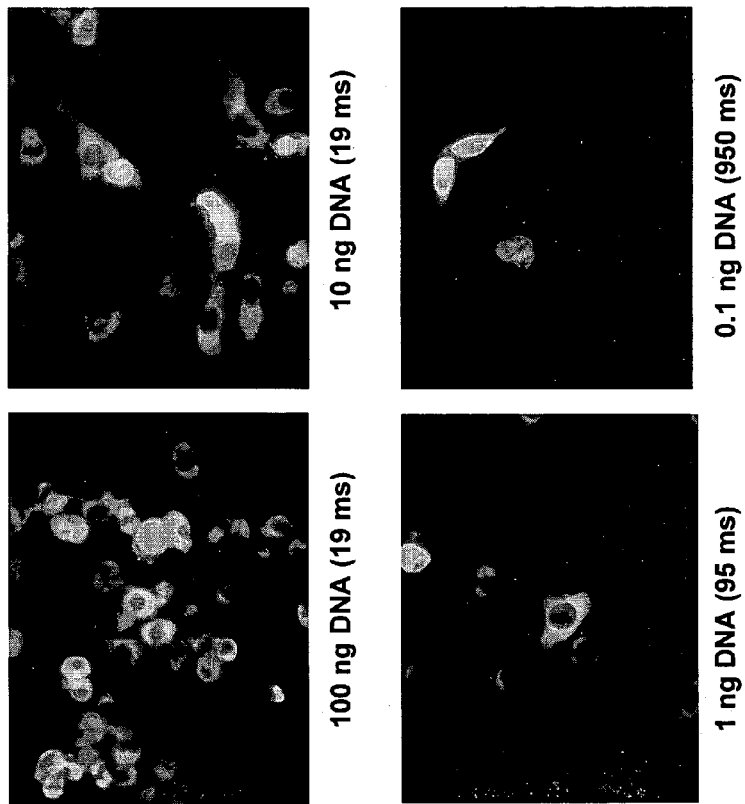
FIGS. 7a and 7b shows the effect of engineering additional mutations into fragments in order to enhance the fluorescent intensities of the final PCA, creating an intense fluorescent PCA (IFP PCA) and allowing for the detection of protein-protein interactions with low (nanogram to sub-nanogram) quantities of DNA.
Figure 7B:
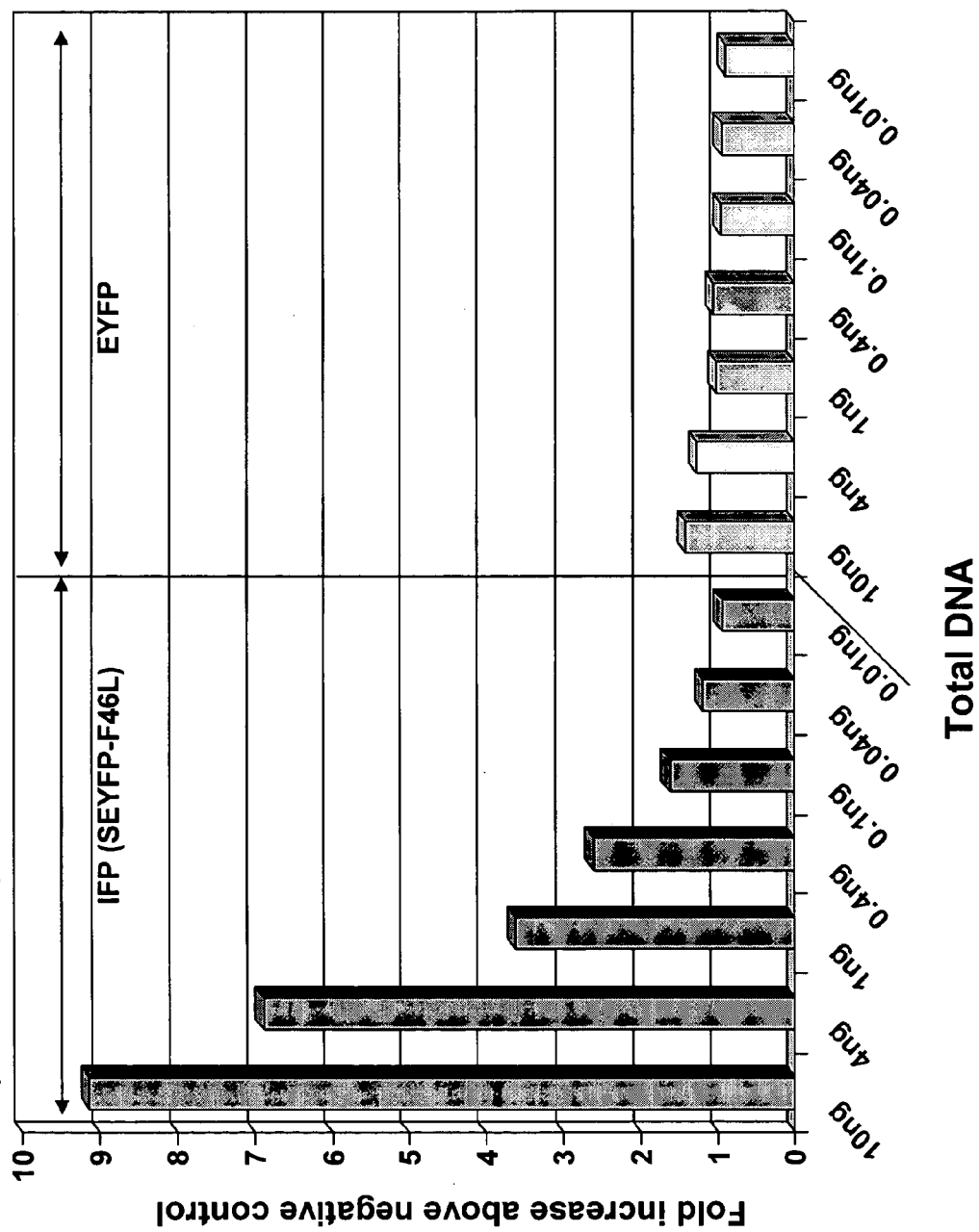

FIGS. 7a and 7b show the creation of yet another novel mutant fluorescent protein PCA allowing even greater sensitivity for biological applications. Mutations were selected based on the YFP variant designated SEYFP-F46L (Venus) in Table 3. These mutations have been shown to accelerate the maturation of the fluorescent signal in the intact protein (T. Nagai et al., 2002, "A variant of yellow fluorescent protein with fast and efficient maturation for cell-biological applications", *Nature Biotech.* 20: 87–90). PCR mutagenesis was employed to incorporate the additional mutations F46L into SEYFP[1], and V163A and S175G into YFP[2], resulting in novel fragments we designated IFP[1] and IFP[2].

Formation of protein-protein complexes between the MAP kinase signaling proteins, MEK and ERK, was assessed with the novel IFP PCA by fusing MEK1 to theN-terminus of IFP[1] and ERK to the C-terminus of IFP[2].

As shown in FIGS. 7a and 7b, a titration series was performed wherein 100 ng of total DNA was transfected per well, with the amount of DNA contributed by the PCA pair varying from 100 ng down to 100 pg, with the remaining DNA supplied by an empty 'carrier' vector. Fluorescence images were acquired 48 hours later on an SP Nikon fluorescence microscope using a HYQ-FITC filter cube (excitation: 460–500 nm; emission: 505–560 nm; dichroic nirror: 505LP). Images were acquired with a CoolSnap HQ CCD camera with the indicated exposure times (in ms). Total fluorescence for each dilution of the MEK/ERK PCA was also quantified on a fluorescence platereader. Triplicate measurements for each dilution were made, and the mean fluorescence value was normalized to the mean fluorescence of a negative control PCA to determine the fold increase above the negative control, as shown in FIG. 7b. Introduction of the additional mutations into the fragments of YFP greatly enhanced the fluorescent signal which could still be visualized (FIG. 7a) and quantified (FIG. 7b) even at 0.1 ng (100 pg) of DNA. That level of DNA for the IFP PCA produced a significant signal above the negative control (1.5-fold increase). In contrast, to produce an equivalent fluorescence intensity with the YFP PCA, 10 ng DNA was needed.

Figure 8:
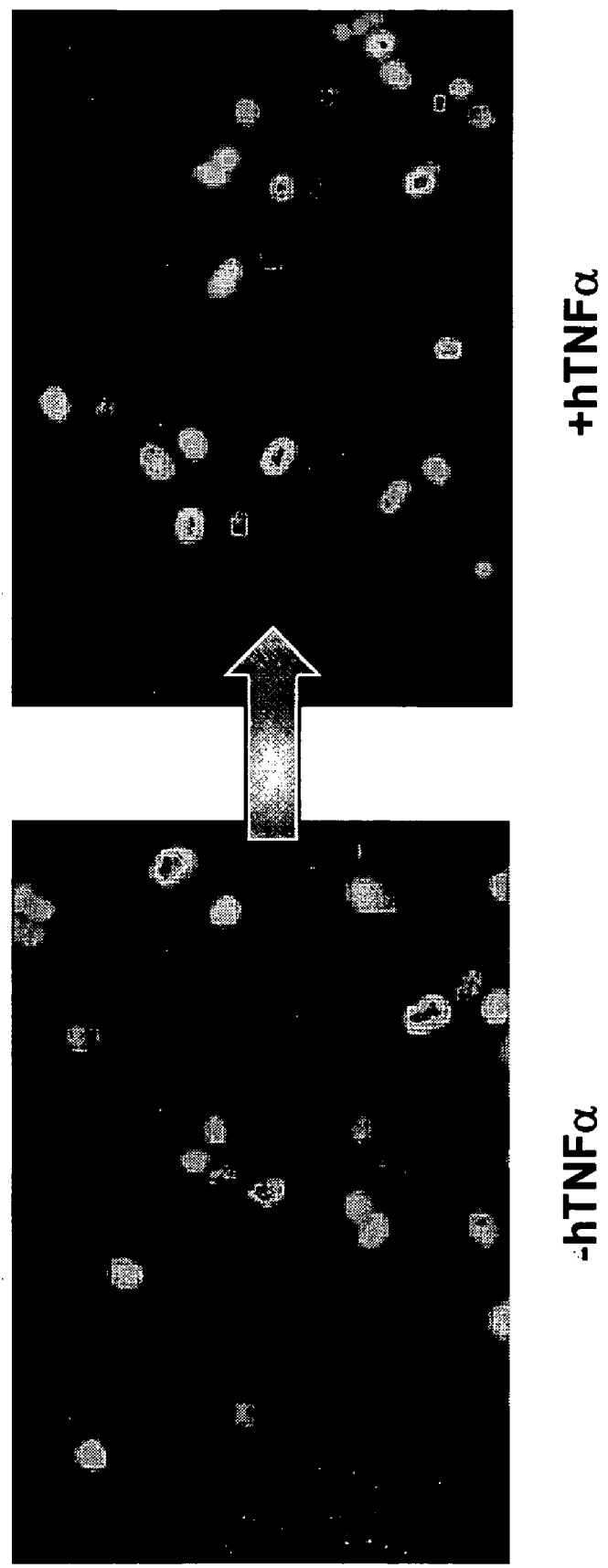
FIG. 8 shows that PCA based on mutant fragments of fluorescent proteins can be used in high-content assays, for example, to detect a change in subcellular localization of protein-protein complexes upon stimulation of living cells by a cytokine as shown here for p65/p50.

The ability to identify the subcellular locations of protein-protein interactions enables high-content screening. For example, the trafficking of proteins within signaling pathways can be seen. For example, we have used this approach with the IFP PCA described above to study the cytokine-induced translocation of the NFκB transcription complex of p65/p50 (FIG. 8). This protein-protein complex translocates from the cytoplasm to the nucleus in live cells in response to tumor necrosis factor. When p65 and p50 are tagged with complementary mutant fragments IFP[1] and IFP[2] respectively in transiently transfected cells, the fluorescent signal can be seen primarily in the cytoplasm in unstimulated cells 48 hours after transfection. Within 30 minutes of treatment of the TNF-responsive HEK cells with TNF-alpha, the fluorescent protein-protein complex moves predominantly to the nucleus.

The above examples demonstrate that mutations can be engineered into fluorescent protein fragments to confer specific desired properties for PCA. Accordingly, we have generated a number of novel fragments of fluorescent proteins incorporating previously described mutations of green fluorescent protein (see Table 2 and Table 3). These mutations have been engineered into fragments generated by fragmentation of fluorescent proteins at the sites depicted in FIG. 1 and described in the above specification. Additionally, we have generated novel fragments at homologous fragmentation sites in coral fluorescent proteins (Table 4), in the monomeric red fluorescent protein (mRFP1) derived from DsRed (Table 5 and Table 6) and a kindling fluorescent protein (KFP1) derived from Anemonia sulcata (Table 7 and Table 8). The sequences of the novel fragments are shown in the Appendix prior to the claims of the present invention and are represented as SEQ ID NOS:20–1067 of the Sequence Listing and are the subject of the claimed invention. In general terms we refer to these as "mutant fragments". For the purposes of the invention, a "mutant fragment" is a fragment of a fluorescent protein that has one or more nucleotide or amino acid changes relative to the wild-type cDNA or protein.

EXAMPLE 4

Spectrally Shifted PCAs

Numerous examples of PCAs generating green fluorescent and yellow fluorescent signals have been described and demonstrated above. The invention described herein allows for PCAs generating a variety of spectral properties depending upon the amino acid sequence of the mutant fragments. In order to further demonstrate this principle, a PCA based on fragments of a cyan fluorescent protein was created to demonstrate blue fluorescence generated by a protein-protein interaction (FIG. 9). Two oligonucleotides corresponding to fragments of CFP were synthesized by Blue Heron Biotechnology (Bothell, Wash.). The resulting fragments were amplified by PCR to attach restriction sites and a flexible 10-aa linker for cloning into a pcDNA3-based expression vector, resulting in vectors containing CFP[1] (encoding aa 1–158 of ECFP) or CFP[2] (encoding aa 159–239 of ECFP) where the CFP had the amino acid sequence shown as ECFP in Table 3. The proteins Pdk2 and 14-3-3σ were fused to the N-terminus of CFP[1] and CFP[2], respectively, while the subunits of the NFκB heterodimer p50 and p65 were fused to the C-terminus of CFP fragments. The construct pairs 14-3σ/14-3-3σ, p65/p50 and the Pdk2/Pdk2 negative control were transiently transfected into HEK293T cells, and fluorescence microscopy was performed after 48 hours. Fluorescence images were acquired on an SP Nikon fluorescence microscope using a Chroma CFP filter (excitation: 426–446 nm; emission: 460–500 nm; dichroic mirror: 455LP). Images were acquired with a CoolSnap HQ CCD camera with exposure times of 1–5 sec, as shown in FIG. 8. The results show that mutations causing a spectral shift in the intact fluorescent protein can be engineered into fragments for PCA, resulting in a PCA generating a blue fluorescent signal with utility for biological applications.

EXAMPLE 5

Multi-color PCAs

The availability of a suite of fluorescent protein PCAs enables the construction of multi-color PCAs for a variety of biology, biotechnology, drug discovery and diagnostic applications. Such multi-color PCAs are another aspect of the invention.

For example, a 'generic' F2 polypeptide fragment could be combined with multiple distinct F1 mutant fragments in order to detect two, three, four or more bimolecular events simultaneously. This can be achieved by fragmenting a fluorescent protein in such a way that F1 contains all the amino acid residues necessary for chromophore formation when complemented by F2. Two or more mutant fragments of F1 are then created. For example, mutant F1 fragments that are capable of reconstituting either a green, yellow, cyan, blue or red signal can be generated. If F2 is fused to molecule A, and the mutant F1 fragments are fused separately to molecules B, C, D, E and F respectively, the interactions of A with B, A with C, A with D, A with E and A with F can all be tested simultaneously by testing for a fluorescence signal at the 5 different wavelengths that are generated by fragment complementation.

Figure 10:
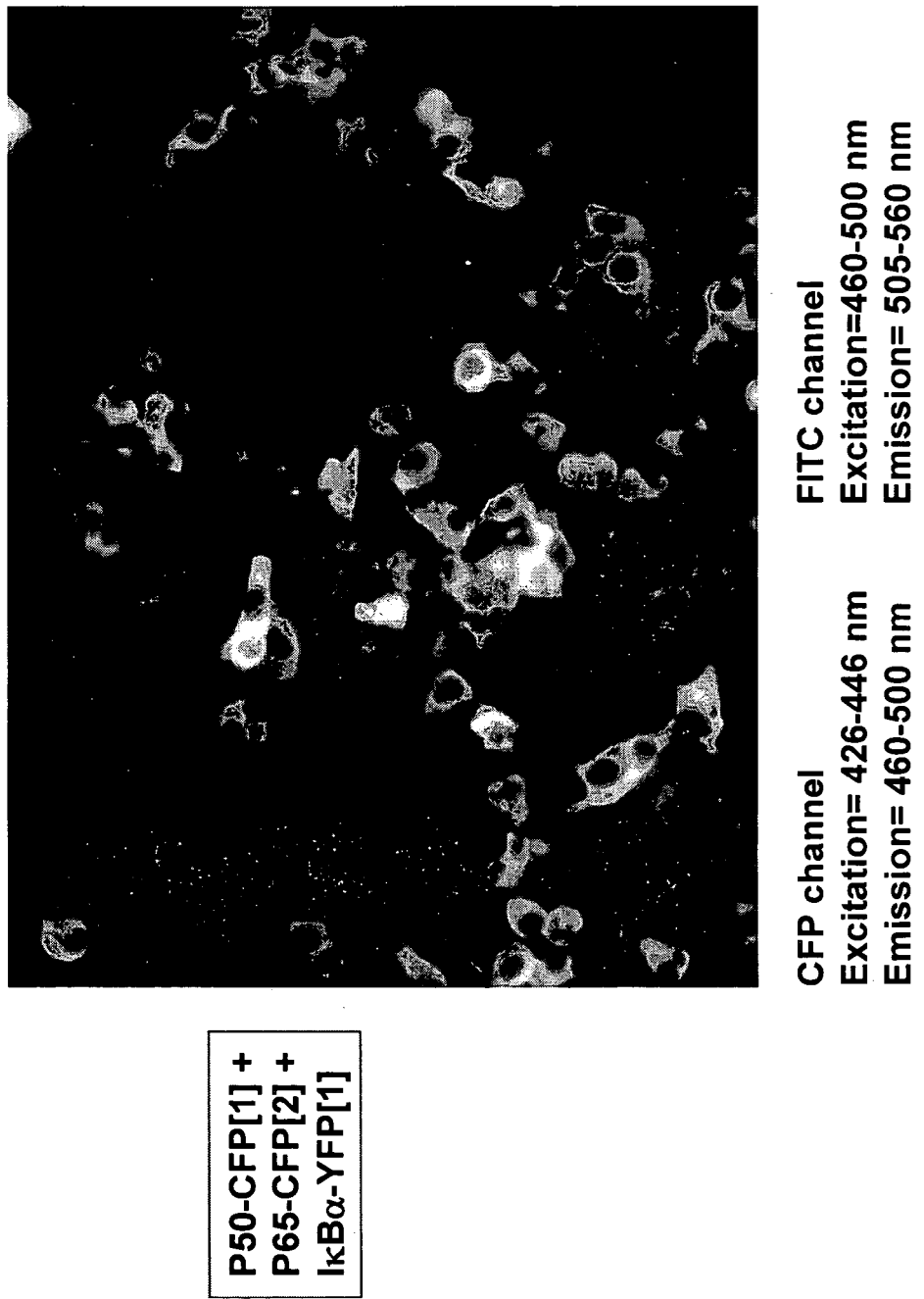

We demonstrated the principles of multi-color PCA in living cells by using the ability of the NFκB p65 subunit to form complexes with the p50 subunit, and also with the protein IkBα, as a model system. In resting cells, IkBα binds to NFkB and retains the complex in the cytoplasm. Thus, p65 forms cytoplasmic protein-protein complexes with p50 and also with IκBα We co-transfected HEK293T cells simultaneously with three PCA constructs: CFP[1]-p50; CFP[2]-p65; and IκBα-YFP[1]. Fluorescence images were acquired with an SP Nikon fluorescence microscope using a Chroma CFP filter (excitation: 426–446 nm; emission: 460–500 nm; dichroic mirror: 455LP), and a FITC filter (excitation: 460–500 nm; emission: 505–560 nm; dichroic mirror: 505LP). 16-bit monochrome images were acquired with a CoolSnap HQ CCD camera. CFP and FITC images for each PCA were subsequently pseudocolored and overlaid using Metamorph software (Molecular Devices). If a protein-protein complex forms between p50 and p65, the CFP [1] fragment should complement the CFP[2] fragment, producing blue fluorescence. Alternatively, if a protein-protein complex forms between IκBα and p65, the YFP[1] fragment should complement the CFP[2] fragment, producing a yellow fluorescence. As shown in FIG. 10, both p65/p50 (blue) and IκBα/p65 (yellow) complexes could be detected in the cytoplasm as expected. Cells displaying a lighter yellow (almost white) cytoplasmic staining pattern are expressing both p65/p50 and IκBα/p65 complexes. The ability to construct multi-color PCAs allows for the detection and quantification of multiple distinct protein-protein complexes within the same cells.

Additional Applications of Fluorescent Protein PCAs

The many practical applications of this invention include high-content and high-throughput assays in living cells, cell lysates, or in vitro formats. The applications of the invention include the detection of pathway activation and pathway 'switching' in living cells by agonists, antagonists and inhibitors. The translocation or trafficking of proteins from one subcellular compartment to another can be followed; if protein A initially binds to protein B at the cell membrane and generates a yellow fluorescent signal, and then moves to the cell nucleus and binds to protein C and generates a cyan fluorescent signal, the ratio of cyan to yellow can be used as a detector of the activation of the translocation event. Moreover, there are many applications for fluorescent protein PCAs in diagnostics and nanotechnology. For example, mutant F1 fragments could be bound to a solid surface array, each one as a fusion with a different antibody, which could be used to detect the presence of specific antigens in a sample. The applications of multicolor PCAs include rapid, multicolor diagnostics for biowarfare agents. Such multicolor PCAs are made possible by the novel mutant fragments that are the subject of the present invention.

The cells can be studied in vitro in a variety of formats including tissue culture plates, microtiter plates, or slide formats. The cells harboring PCA constructs can also be studied in vivo. For example, suitable cultured cells stably expressing a particular PCA can be grown as ascites in living animals, or introduced into nude mice to form tumors. Alternative, transgenic mice harboring the PCA constructs can be made. The protein-protein complexes within the animal can then be studied by whole animal imaging systems, for example, those supplied by Xenogen (Alameda, Calif.) or Anti-Cancer (San Diego, Calif.). All the PCAs presented here, and the various intense yellow and red fluorescent PCAs, will be particularly useful for PCA in vivo. In vivo PCA applications include the ability to generate a PCA that responds in vivo to the consumption or injection of a drug by the animal. Applications to pre-clinical drug development include the ability to perform ADME studies (absorption, distribution, metabolism or excretion of a drug) in live animals without sampling blood or urine. For example, if a drug causes an increase or decrease in a specific protein-protein complex within a cell in the live animal, the fluorescent signal can be acquired at various times after drug administration which will allow estimation of the pharmacokinetic and pharmacodynamic properties of the drug in whole animals.

Finally, the availability of a wide range of complementing mutant fragments of fluorescent proteins enables empirical testing for mutant fragment combinations that are particularly useful for PCA. It is likely that this combinatorial feature of PCA will enable the generation of a large number of novel assays with a range of colors, intensities, combinations and physical properties for use in drug screening, target validation, ADME, and diagnostics applications.

The entire contents including the references cited therein of the following patents and publications are incorporated by reference in their entirety for all purposes to the same extent as if each individual patent, patent application or publication were so individually denoted.

U.S. Pat. No. 6,270,964 Michnick, et al.
U.S. Pat. No. 6,294,330 Michnick, et al.
U.S. Pat. No. 6,428,951 Michnick, et al.
U.S. Pat. No. 5,804,387 Cormack, et al.
U.S. Pat. No. 5,625,048 Tsien, et al.
U.S. Pat. No. 6,054,321 Tsien, et al.
U.S. Pat. No. 6,027,881 Pavlakis, et al.
U.S. Pat. No. 6,469,154 Tsien, et al.
U.S. Pat. No. 6,066,476 Tsien, et al.
U.S. Pat. No. 6,172,188 Thastrup, et al.
U.S. Pat. No. 6,968,738 Anderson, et al.
U.S. Pat. No. 6,090,919 Cormack et al.
U.S. Pat. No. 6,124,128 Tsien, et al.
U.S. Pat. No. 6,518,021 Thastrup, et al.

Pelletier, J. N., Remy, I. and Michnick, S. W. 1998, Protein-Fragment complementation Assays: a general strategy for the in vivo detection of Protein-Protein Interactions. J. Biomolecular Techniques 10:32–19.

Remy, I., Pelletier, J. N., Galarneau, A. and Michnick, S. W.,2002, Protein Interactions and Library Screening with Protein Fragment Complementation Strategies. in: Protein-protein Interactions: A Molecular Cloning Manual. E. A. Golemis, Editor. Cold Spring Harbor Laboratory Press. Chapter 25, 449–475.

Michnick, S. W., Remy, I., C.-Valois, F. X., Vallee-Belisle, A., Galarneau, A. and Pelletier, J. N., 2000, Detection of Protein-Protein Interactions by Protein Fragment Complementation Strategies, Parts A and B (John N. Abelson, Scott D. Emr and Jeremy Thorner, Editors) in: Methods in Enzymology 328: 208–230.

J. N. Pelletier and S. W. Michnick., 1997, A Strategy for Detecting Protein-Protein Interactions in vivo Based on Protein Fragment Complementation. *Protein Engineering*, 10(Suppl.): 89.

I. Ghosh, A. D. Hamilton and L. Regan, 2000, Antiparallel leucine zipper-directed protein reassembly: application to the green fluorescent protein. J. Am. Chem. Soc 122:5658–5659, 2000

C.-D. Hu et al., 2002, Visualization of interactions among bZIP and Rel family proteins in living cells using bimolecular fluorescence complementation. Molecular Cell 9: 789–798.

Tsien, R. Y., 1998, The Green Fluorescent Protein. in: Annual Reviews of Biochemistry 67: 509–544.

Zhang J., Campbell R. E., Ting A. Y. and Tsien, R. T. (2000) Creating new fluorescent probes for cell biology. Nature Reviews 3: 906–918.

The sequences of the novel fragments are shown in the Appendix below and are represented as SEQ ID NOS: 20–1067 of the Sequence Listing and are the subject of the claimed invention.

While the many forms of the invention herein disclosed constitute presently preferred embodiments, many others are possible and further details of the preferred embodiments and other possible embodiments are not to be construed as limitations. It is understood that the terms used herein are merely descriptive rather than limiting and that various changes many equivalents may be made without departing from the spirit or scope of the claimed invention.

SEQUENCE LISTING (1067 sequences)

SEQ ID NO: 1 - DNA, 714 bp, Aequorea victoria
  CDS (1)..(714): wild-type green fluorescent protein
atgagtaaaggagaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttctcttatggtgttcaatgcttttcaagatacccagatcatatgaaacggcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaa

SEQ ID NO: 2 - protein, 238 aa, Aequorea victoria
MSKGEELFTGVVPILVELDGDVNGHKFSVSGEGEGDATYGKLTLKFICTTGKLPVPWPTLVTTFSYGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 3 - protein, 239 aa, Artificial
  "EGFP", an Aequorea-derived mutated variant of wild-type green fl uorescent protei
  ref <301>: AUTHORS: Zhang, J. et al
  ref <302>: TITLE: Creating new fluorescent probes for cell biology
  ref <303>: JOURNAL: Nat. Rev. Mol. Cell Biol.
  ref <304>: VOLUME: 3
  ref <305>: ISSUE: 12
  ref <306>: PAGES: 906-918
  ref <307>: DATE: 2002-__ -__
  ref <313>: RELEVANT RESIDUES: (1)..(239)
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 4 - protein, 239 aa, Artificial
  "EYFP", enhanced yellow fluorescent protein,  an Aequorea-derived mutated variant of wild-type green fluorescent protei
  ref <301>: AUTHORS: Zhang, J. et al
  ref <302>: TITLE: Creating new fluorescent probes for cell biology
  ref <303>: JOURNAL: Nat. Rev. Mol. Cell Biol.
  ref <304>: VOLUME: 3
  ref <305>: ISSUE: 12
  ref <306>: PAGES: 906-918
  ref <307>: DATE: 2002-__-__
  ref <313>: RELEVANT RESIDUES: (1)..(239)
MVSKGEELFTGVVPILVELDGDVNGHKFSVSGEGEGDATYGKLTLKFICTTGKLPVPWPTLVTTFGYGLQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 5 - protein, 239 aa, Artificial
  "EYFP-Q69M",  citrine fluorescent protein variant of EYFP,  a Met residue replaces Gln at position 69 (numbering is relative to wt GFP
  ref <301>: AUTHORS: Zhang, J. et al.
  ref <302>: TITLE: Creating new fluorescent probes for cell biology
  ref <303>: JOURNAL: Nat. Rev. Mol. Cell Biol.
  ref <304>: VOLUME: 3
  ref <305>: ISSUE: 12
  ref <306>: PAGES: 906-918
  ref <307>: DATE: 2002-__-__
  ref <313>: RELEVANT RESIDUES: (1)..(239)
MVSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 6 - protein, 239 aa, Artificial
  "SEYFP", super enhanced yellow fluorescent protein, a mutated var iant of EYF
  ref <301>: AUTHORS: Zhang, J. et al
  ref <302>: TITLE: Creating new fluorescent probes for cell biology
  ref <303>: JOURNAL: Nat. REv. Mol. Cell Biol.
  ref <304>: VOLUME: 3
  ref <305>: ISSUE: 12
  ref <306>: PAGES: 906-918
  ref <307>: DATE: 2002-__-__
  ref <313>: RELEVANT RESIDUES: (1)..(239)
MVSKGEELFTGVVPILVELDGDVNGHKFSVSGEGEGDATYGKLTLKFICTTGKLPVPWPTLVTTLGYGLQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 7 - protein, 239 aa, Artificial
  "SEYFP-F46L" known as 'Venus' fluorescent protein, a mutated vari ant of SEYFP; " Leu" replaces" Phe" at position 46 (numbering is relative to wt GFP
  ref <301>: AUTHORS: Zhang, J. et al
  ref <302>: TITLE: Creating new fluorescent probes for cell biology
  ref <303>: JOURNAL: Nat. Rev. Mol. Cell Biol.
  ref <304>: VOLUME: 3
  ref <305>: ISSUE: 12
  ref <306>: PAGES: 906-918
  ref <307>: DATE: 2002-__-__
  ref <313>: RELEVANT RESIDUES: (1)..(239)
MVSKGEELFTGVVPILVELDGDVNGHKFSVSGEGEGDATYGKLTLKLICTTGKLPVPWPTLVTTLGYGLQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 8 - protein, 239 aa, Artificial
  "ECFP", cyan fluorescent protein, an Aequorea-derived mutated var iant of wt green fluorescent protei
  ref <301>: AUTHORS: Zhang, J. et al
  ref <302>: TITLE: Creating new fluorescent probes for cell biology
  ref <303>: JOURNAL: Nat. Rev. Mol. Cell Biol.
  ref <304>: VOLUME: 3
  ref <305>: ISSUE: 12
  ref <306>: PAGES: 906-918
  ref <307>: DATE: 2002-__-__
  ref <313>: RELEVANT RESIDUES: (1)..(239)
MVSKGEELFTGVVPILVELDGDVNGHKFSVSGEGEGDATYGKLTLKFICTTGKLPVPWPTLVTTLTWGVQCFSRYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 9 - protein, 231 aa, Anthozoa zoanthus;
  misc_feature: Zoanthus ("z") FP506
  ref <301>: AUTHORS: Matz, M.V. et al
  ref <302>: TITLE: Fluorescent proteins from nonbioluminescent Anthozoa species
  ref <303>: JOURNAL: Nat. Biotech.
  ref <304>: VOLUME: 17
  ref <305>: ISSUE: 10
  ref <306>: PAGES: 969-73
  ref <307>: DATE: 1999-__-__
  ref <313>: RELEVANT RESIDUES: (1)..(231)
MAQSKHGLTKFMTMKYRMEGCVDGHKFVITGEGIGYPFKGKQAINLCVVEGGPLPFAEDILSAAFNYGNRVFTEYPQDIVDYFKNSCPAGYTWDRSFLFEDGAVCICNADITVSVEENCMYHESKFYGVNFPADGPVMKKMTDNWEPSCEKIIPVPKQGILKGDVSMYLLLKDGGRLRCQFDTVYKAKSVPRKMPDWHFIQHKLTREDRSDAKNQKWHLTEHAIASGSALP

SEQ ID NO: 10 - protein, 231 aa, Anthozoa zoanthus;
  misc_feature: Zoanthus ("z") FP538
  ref <301>: AUTHORS: Matz, M.V. et al
  ref <302>: TITLE: Fluorescent proteins from nonbioluminescent Anthozoa species
  ref <303>: JOURNAL: Nat. Biotech.
  ref <304>: VOLUME: 17
  ref <305>: ISSUE: 10
  ref <306>: PAGES: 969-73
  ref <307>: DATE: 1999-__-__
  ref <313>: RELEVANT RESIDUES: (1)..(231)
MAHSKHGLKEEMTMKYHMEGCVNGHKFVITGEGIGYPFKGKQTINLCVIEGGPLPFSEDILSAGFKYGDRIFTEYPQDIVDYFKNSCPAGYTWGRSFLFEDGAVCICNVDITVSVKENCIYHKSIFNGMNFPADGPVMKKMTTNWEASCEKIMPVPKQGILKGDVSMYLLLKDGGRYRCQFDTVYKAKSVPSKMPEWHFIQHKLLREDRSDAKNQKWQLTEHAIAFPSALA

SEQ ID NO: 11 - protein, 232 aa, Anthozoa discosoma;
  misc_feature: Discosoma striata ("ds") FP483
  ref <301>: AUTHORS: Matz, M.V. et al
  ref <302>: TITLE: Fluorescent proteins from nonbioluminescent Anthozoa species
  ref <303>: JOURNAL: Nat. Biotech.
  ref <304>: VOLUME: 17
  ref <305>: ISSUE: 10
  ref <306>: PAGES: 969-73
  ref <307>: DATE: 1999-__-__
  ref <313>: RELEVANT RESIDUES: (1)..(232)
MSCSKSVIKEEMLIDLHLEGTFNGHYFFIKGKGKGQPNEGTNTVTLEVTKGGPLPFGWHILCPQFQYGNKAFVHHPDNIHDYLKLSFPEGYTWERSMHFEDGGLCCITNDISLTGNCFYYDIKFTGLNFPPNGPVVQKKTTGWEPSTERLYPRDGVLIGDIHHALTVEGGGHYACDIKTVYRAKKAALKMPGYHYVDTKLVIWNNDKEFMKVEEHEIAVARHHPFYEPKKDK

SEQ ID NO: 12 - protein, 226 aa, Anthozoa discosoma;
  misc_feature: Discosoma red ("dr") FP583
  ref <301>: AUTHORS: Matz, M.V. et al
  ref <302>: TITLE: Fluorescent proteins from nonbioluminescent Anthozoa species
  ref <303>: JOURNAL: Nat. Biotech.
  ref <304>: VOLUME: 17
  ref <305>: ISSUE: 10
  ref <306>: PAGES: 969-73
  ref <307>: DATE: 1999-__-__
  ref <313>: RELEVANT RESIDUES: (1)..(226)
MRSSKNVIKEFMRFKVRMEGTVNGHEFFIEGEGEGRPYEGHNTVKLKVTKGGPLPFAWDILSPQFQYGSKVYVKHPADIPDYKKLSFPEGFKWERVMNFEDGGVVTVTQDSSLQDGCFIYKVKFIGVNFPSDGPVMQKKTMGWEASTERLYPRDGVLKGEIHKALKLKDGGHYLVEFKSIYMAKKAPVQLPGYYYVDSKLDITSHNEDYTIVEQYERTEGRHHLFL

SEQ ID NO: 13 - protein, 229 aa, Anthozoa anemonia majano;
  misc_feature: anemonia majano ("am") FP486
  ref <301>: AUTHORS: Matz, M.V. et al
  ref <302>: TITLE: Fluorescent proteins from nonbioluminescent  Anthozoa species
  ref <303>: JOURNAL: Nat. Biotech.
  ref <304>: VOLUME: 17
  ref <305>: ISSUE: 10
  ref <306>: PAGES: 969-73
  ref <307>: DATE: 1999-__-__
  ref <313>: RELEVANT RESIDUES: (1)..(229)
MALSNKFIGDDMKMTYHMDGCVNGHYFTVKGEGNGKPYEGTQTSTFKVTMANGGPLAFSFDILSTVFKYGNRCFTAYPTSMPDYFKQAFPDGMSYERTFTYEDGGVATASWEISLKGNCFEHKSTFHGVNFPADGPVMAKKTTGWDPSFEKMTVCDGILKGDVTAFLMLQGGGNYRCQFHTSYKTKKPVTMPPNHVVEHRIARTDLDKGGNSVQLTEHAVAHITSVVPF

SEQ ID NO: 14 - protein, 231 aa, Anthozoa clavularia;
  misc_feature: Clavularia ("c") FP484
  ref <301>: AUTHORS: Matz, M.V. et al
  ref <302>: TITLE: Fluorescent proteins from nonbioluminescent Anthozoa species
  ref <303>: JOURNAL: Nat. Biotech.
  ref <304>: VOLUME: 17
  ref <305>: ISSUE: 10
  ref <306>: PAGES: 969-73
  ref <307>: DATE: 1999-__-__
  ref <313>: RELEVANT RESIDUES: (1)..(231)
KALTTMGVIKPDMKIKLKMEGNVNGHAFVIEGEGEGKPYDGTHTLNLEVKMAEGAPLPFSYDILSNAFQYGNRALTKYPDDIADYFKQSFPEGYSWERTMTFEDKGIVKVKSDISMEEDSFIYEIRFDGMNFPPNGPVMQKKTLKWEPSTEIMYVRDGVLVGDISHSLLLEGGGHYRCDFKSIYKAKKVVKLPDYHFVDHRIEILNHDKDYNKVTLYENAVARYSLLPSQA

SEQ ID NO: 15 - DNA, 675 bp, Artificial
  "mRFP1", an engineered monomeric form of DsRed  FP
  CDS (1)..(675)
  ref <301>: AUTHORS: Campbell, R.E. et al
  ref <302>: TITLE: A monomeric red fluorescent protein
  ref <303>: JOURNAL: Proc. Nat'l. Acad. Sci.
  ref <304>: VOLUME: 99
  ref <305>: ISSUE: 12
  ref <306>: PAGES: 7877-82
  ref <307>: DATE: 2002-06-11
  ref <313>: RELEVANT RESIDUES: (1)..(675)
atggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttccagtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctccaccgagcggatgtaccccgaggacggcgccctgaagggcgagatcaagatgaggctgaagctgaaggacggcggccactacgacgccgaggtcaagaccacctacatggccaagaagcccgtgcagctgcccggcgcctacaagaccgacatcaagctggacatcacctcccacaacgaggactacaccatcgtggaacagtacgagcgcgccgagggccgccactccaccggcgcc

SEQ ID NO: 16 - protein, 225 aa, Artificial
  "mRFP1", an engineered monomeric form of DsRed  FP
MASSEDVIKEFMRFKVRMEGSVNGHEFEIEGEGEGRPYEGTQTAKLKVTKGGPLPFAWDILSPQFQYGSKAYVKHPADIPDYLKLSFPEGFKWERVMNFEDGGVVTVTQDSSLQDGEFIYKVKLRGTNFPSDGPVMQKKTMGWEASTERMYPEDGALKGEIKMRLKLKDGGHYDAEVKTTYMAKKPVQLPGAYKTDIKLDITSHNEDYTIVEQYERAEGRHSTGA

SEQ ID NO: 17 - DNA, 696 bp, Artificial
  "KFP1" a mutated variant of kindling fluorescent protein asCP fro m A. sulcata
  CDS (1)..(696)
atggcctccctgctgaccgagaccatgcccttcaagaccaccatcgagggcaccgtgaacggccactgcttcaagtgcatcggcaagggcgagggcaaccccttcgagggcacccaggagatgaagatcgaggtgatcgagggcggccccctgcccttcgccttccacatcctgtccacctcctgcatgtacggctccaagaccttcatcaagtacgtgtccggcatccccgactacttcaagcagtccttccccgagggcttcacctgggagcgcaccaccacctacgaggacggcggcttcctgaccgcccaccaggacacctccctggacggcgactgcctggtgtacaaggtgaagatcctgggtaacaacttccccgccgacggccccgtgatgcagaacaaggtcggccgctgggagcccggaaccgagatcgtgtacgaggtggacggcgtgctgcgcggccagtccctgatggccctgaagtgccccggcggccggcacctgacctgccacctgcacaccacctaccgctccaagaagcccgcctccgccctgaagatgcccggcttccacttcgaggaccaccgcatcgagatcatggaggaggtggagaagggcaagtgctacaagcagtacgaggccgccgtgggccgctactgcgacgccgccccctccaagctgggccacaac

SEQ ID NO: 18 - protein, 232 aa, Artificial
  "KFP1" a mutated variant of kindling fluorescent protein asCP fro m A. sulcata
MASLLTETMPFKTTIEGTVNGHCFKCIGKGEGNPFEGTQEMKIEVIEGGPLPFAFHILSTSCMYGSKTFIKYVSGIPDYFKQSFPEGFTWERTTTYEDGGFLTAHQDTSLDGDCLVYKVKILGNNFPADGPVMQNKVGRWEPGTEIVYEVDGVLRGQSLMALKCPGGRHLTCHLHTTYRSKKPASALKMPGFHFEDHRIEIMEEVEKGKCYKQYEAAVGRYCDAAPSKLGHN

SEQ ID NO: 19 - protein, 10 aa, Artificial
  flexible linker
GGGGSGGGGS

SEQ ID NO: 20 - DNA, 114 bp, Artificial
  modified fragment= GFP F1(aa 1-39 of wt GFP) w/o. Met @ position 1
  CDS (1)..(114)
agtaaaggagaagaacttttcactggagttgtcccaattcttgttgaattagatggtgatgttaatgggcacaaattttctgtcagtggagagggtgaaggtgatgcaacatac

SEQ ID NO: 21 - protein, 38 aa, Artificial
  modified fragment= GFP F1 (aa 1-39 of wt GFP) w/o. Met @ position 1
SKGEELFTGVVPILVELDGDVNGHKFSVSGEGEGDATY

SEQ ID NO: 22 - DNA, 600 bp, Artificial
  modified frag.; GFP F2 (aa 40-238 of wt GFP) + Met @  position 1
  CDS (1)..(600)
atgggaaaacttacccttaaatttatttgcactactggaaaactacctgttccatggccaacacttgtcactactttctcttatggtgttcaatgcttttcaagatacccagatcatatgaaacggcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaa

SEQ ID NO: 23 - protein, 200 aa, Artificial
  modified frag.; GFP F2 (aa 40-238 of wt GFP) + Met @  position 1
MGKLTLKFICTTGKLPVPWPTLVTTFSYGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 24 - DNA, 117 bp, Artificial
  modified frag.;  YFP F1A (aa 1-40 of EYFP) - Met @ position 1
  CDS (1)..(117)
gtgagcaagggcgaggagctgttcaccggggtggtgcccatcctggtcgagctggacggcgacgtaaacggccacaagttcagcgtgtccggcgagggcgagggcgatgccacctac

SEQ ID NO: 25 - protein, 39 aa, Artificial
  modified frag.; YFP F1A (aa 1-40 of EYFP) - Met @ position 1
VSKGEELFTGVVPILVELDGDVNGHKFSVSGEGEGDATY

SEQ ID NO: 26 - DNA, 600 bp, Artificial
  modified frag.; YFP F2A (aa 41-239 of EYFP) + Met @ position 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 27 - protein, 200 aa, Artificial
  modified frag.; YFP F2A (aa 41-239 of EYFP) + Met @ position 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 28 - DNA, 597 bp, Artificial
  modified frag.;  YFPF2A w.  F46L mutation
  CDS (1)..(597)
ggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 29 - protein, 199 aa, Artificial
  modified frag.;  YFPF2A w.  F46L mutation
GKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 30 - DNA, 600 bp, Artificial
  modified frag., YFPF2A  w.  F46L mutation + Met @ postion 1
  CDS (1)..(600)
atgggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 31 - protein, 200 aa, Artificial
  modified frag., YFPF2A  w.  F46L mutation + Met @ postion 1
MGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 32 - DNA, 597 bp, Artificial
  modified frag.; YFPF2A  with  F46L/F64L mutations
  CDS (1)..(597)
ggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 33 - protein, 199 aa, Artificial
  modified frag.; YFPF2A  with  F46L/F64L mutations
GKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 34 - DNA, 600 bp, Artificial
  modified frag.; YFPF2A  w.  F46L/F64L  mutations + Met @ posit. 1
  CDS (1)..(600)
atgggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 35 - protein, 200 aa, Artificial
  modified frag.; YFPF2A  w. F46L/F64L  mutations + Met @ posit. 1
MGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 36 - DNA, 597 bp, Artificial
  modified frag.; YFPF2A  with  F64L mutation
  CDS (1)..(597)
ggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 37 - protein, 199 aa, Artificial
  modified frag.; YFPF2A  with  F64L mutation
GKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 38 - DNA, 600 bp, Artificial
  modified frag.; YFPF2A  w.  F64L mutation + Met @ position 1
  CDS (1)..(600)
atgggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 39 - protein, 200 aa, Artificial
  modified frag.; YFPF2A  w.  F64L mutation + Met @ position 1
MGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 40 - DNA, 597 bp, Artificial
  modified frag.; YFPF2A  with  K79R mutation
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgcgccggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 41 - protein, 199 aa, Artificial
  modified frag.; YFPF2A  with  K79R mutation
GKLTLKFICTTGKLPVPWPTLVTTFGYGLQCFARYPDHMRRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 42 - DNA, 600 bp, Artificial
  modified frag.; YFPF2A  with  K79R mutation + Met @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgcgccggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 43 - protein, 200 aa, Artificial
  modified frag.; YFPF2A  with  K79R mutation + Met @ posit. 1
MGKLTLKFICTTGKLPVPWPTLVTTFGYGLQCFARYPDHMRRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 44 - DNA, 597 bp, Artificial
  modified frag.; YFPF2A  with  Y66F mutation
  CDS (1)..(597)
ggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 45 - protein, 199 aa, Artificial
  modified frag.; YFPF2A  with  Y66F mutation
GKLTLKFICTTGKLPVPWPTLVTTFGFGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 46 - DNA, 600 bp, Artificial
  modified frag.; YFPF2A  with  Y66F mutation + Met @ posit. 1
  CDS (1)..(600)
atgggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 47 - protein, 200 aa, Artificial
  modified frag.; YFPF2A  with  Y66F mutation + Met @ posit. 1
MGKLTLKFICTTGKLPVPWPTLVTTFGFGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 48 - DNA, 597 bp, Artificial
  modified frag.; YFPF2A  with  Q69K mutation
  CDS (1)..(597)
ggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 49 - protein, 199 aa, Artificial
  modified frag.; YFPF2A  with  Q69K mutation
GKLTLKFICTTGKLPVPWPTLVTTFGYGLKCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 50 - DNA, 600 bp, Artificial
  modified frag.; YFPF2A  with  Q69K mutation + Met @ posit. 1
  CDS (1)..(600)
atgggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 51 - protein, 200 aa, Artificial
  modified frag.; YFPF2A  with  Q69K mutation + Met @ posit. 1
MGKLTLKFICTTGKLPVPWPTLVTTFGYGLKCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 52 - DNA, 597 bp, Artificial
  modified frag.; citrine F2A , V68L/ Q69K mutations
  CDS (1)..(597)
ggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 53 - protein, 199 aa, Artificial
  modified frag.; citrine F2A , V68L/ Q69K mutations
GKLTLKFICTTGKLPVPWPTLVTTFGYGLMCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 54 - DNA, 600 bp, Artificial
  modif. frag.; citrine F2A , V68L/ Q69K mutations + Met @ posit. 1
  CDS (1)..(600)
atgggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 55 - protein, 200 aa, Artificial
  modif. frag.; citrine F2A , V68L/ Q69K mutations + Met @ posit. 1
MGKLTLKFICTTGKLPVPWPTLVTTFGYGLMCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 56 - DNA, 597 bp, Artificial
  modif. frag.;citrine/VenusF2A, V68L/Q69K/N146I/M153T/V163A mutations
  CDS (1)..(597)
ggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 57 - protein, 199 aa, Artificial
  modif. frag.;citrine/VenusF2A, V68L/Q69K/N146I/M153T/V163A mutations
GKLTLKFICTTGKLPVPWPTLVTTFGYGLMCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 58 - DNA, 600 bp, Artificial
  modif. frag.; citrine/Venus F2A  V68L/Q69K/N146I/M153T/V163A mutations + Met @ posit. 1
  CDS (1)..(600)
atgggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 59 - protein, 200 aa, Artificial
  modif. frag.; citrine/Venus F2A  V68L/Q69K/N146I/M153T/V163A mutations + Met @ posit. 1
MGKLTLKFICTTGKLPVPWPTLVTTFGYGLMCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 60 - DNA, 597 bp, Artificial; identical to SEQ ID NO: 36
  modif. frag.; CFP F2A, F64L mutation
  CDS (1)..(597)

SEQ ID NO: 61 - protein, 199 aa, Artificial; identical to SEQ ID NO: 37
  modif. frag.; CFP F2A, F64L mutation

SEQ ID NO: 62 - DNA, 600 bp, Artificial; identical to SEQ ID NO: 38
  modif. frag.; CFP F2A, F64L mutation + Met @ posit. 1
  CDS (1)..(600)

SEQ ID NO: 63 - protein, 200 aa, Artificial; identical to SEQ ID NO: 39
  modif. frag.; CFP F2A, F64L mutation + Met @ posit. 1

SEQ ID NO: 64 - DNA, 597 bp, Artificial
  modif. frag.; CFP F2A , Y66W  mutation
  CDS (1)..(597)
ggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 65 - protein, 199 aa, Artificial
  modif. frag.; CFP F2A , Y66W  mutation
GKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 66 - DNA, 600 bp, Artificial
  modif. frag.; CFP F2A , Y66W  mutation + Met @ posit. 1
  CDS (1)..(600)
atgggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 67 - protein, 200 aa, Artificial
  modif. frag.; CFP F2A , Y66W  mutation + Met @ posit. 1
MGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 68 - DNA, 597 bp, Artificial
  modif. frag.; CFP F2A , S65A  mutation
  CDS (1)..(597)
ggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 69 - protein, 199 aa, Artificial
  modif. frag.; CFP F2A , S65A  mutation
GKLTLKFICTTGKLPVPWPTLVTTFAYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 70 - DNA, 600 bp, Artificial
  modif. frag.; CFP F2A , S65A  mutation + Met @ posit 1
  CDS (1)..(600)
atgggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 71 - protein, 200 aa, Artificial
  modif. frag.; CFP F2A , S65A  mutation + Met @ posit 1
MGKLTLKFICTTGKLPVPWPTLVTTFAYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 72 - DNA, 597 bp, Artificial
  modif. frag.; CGFP F2A, S65A/Y66W/T203Y  mutations
  CDS (1)..(597)
ggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 73 - protein, 199 aa, Artificial
  modif. frag.; CGFP F2A, S65A/Y66W/T203Y  mutations
GKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 74 - DNA, 600 bp, Artificial
  modif. frag.; CGFP F2A, S65A/Y66W/T203Y mutations + Met @ pos. 1
  CDS (1)..(600)
atgggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 75 - protein, 200 aa, Artificial
  modif. frag.; CGFP F2A, S65A/Y66W/T203Y mutations + Met @ pos. 1
MGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 76 - DNA, 597 bp, Artificial
  modif. frag. CGFP F2A , F64L/S65T/Y66W/M153T/V163A/T203Y mutations
  CDS (1)..(597)
ggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 77 - protein, 199 aa, Artificial
  modif. frag. CGFP F2A , F64L/S65T/Y66W/M153T/V163A/T203Y mutations
GKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 78 - DNA, 600 bp, Artificial
  modif. frag. CGFP F2A, F64L/S65T/Y66W/M153T/V163A/T203Y mutations + Met @ posit. 1
  CDS (1)..(600)
atgggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 79 - protein, 200 aa, Artificial
  modif. frag. CGFP F2A, F64L/S65T/Y66W/M153T/V163A/T203Y mutations + Met @ posit. 1
MGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 80 - DNA, 597 bp, Artificial
  modif. frag., CFP F2A, F46L/S65T/Y66W/N146I/M153T/V163A mutations
  CDS (1)..(597)
ggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 81 - protein, 199 aa, Artificial
  modif. frag., CFP F2A, F46L/S65T/Y66W/N146I/M153T/V163A mutations
GKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 82 - DNA, 600 bp, Artificial
  modif. frag. CFP F2A, F46L/S65T/Y66W/N146I/M153T/V163A mutations + Met @ posit. 1
  CDS (1)..(600)
atgggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 83 - protein, 200 aa, Artificial
  modif. frag. CFP F2A, F46L/S65T/Y66W/N146I/M153T/V163A mutations + Met @ posit. 1
MGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 84 - DNA, 597 bp, Artificial
  modif. frag. CFP F2A, N146I mutation
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 85 - protein, 199 aa, Artificial
  modif. frag. CFP F2A, N146I mutation
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 86 - DNA, 600 bp, Artificial
  modif. frag. CFP F2A, N146I mutation + Met @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 87 - protein, 200 aa, Artificial
  modif. frag. CFP F2A, N146I mutation + Met @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 88 - DNA, 597 bp, Artificial
  modif. frag. CFP F2A, M153T mutation
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 89 - protein, 199 aa, Artificial
  modif. frag. CFP F2A, M153T mutation
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 90 - DNA, 600 bp, Artificial
  modif. frag. CFP F2A, M153T mutation + Met @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 91 - protein, 200 aa, Artificial
  modif. frag. CFP F2A, M153T mutation + Met @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 92 - DNA, 597 bp, Artificial
  modif. frag. CFP F2A, N146I/ M153T mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 93 - protein, 199 aa, Artificial
  modif. frag. CFP F2A, N146I/ M153T mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 94 - DNA, 600 bp, Artificial
  modif. frag. CFP F2A, N146I/ M153T mutations + Met @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 95 - protein, 200 aa, Artificial
  modif. frag. CFP F2A, N146I/ M153T mutations + Met @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 96 - DNA, 597 bp, Artificial
  modif. frag.; CFP F2A, F64L/S65T/Y66W/N146I/M153T mutations
  CDS (1)..(597)
ggcaagctgaccctgaagttcatctgcaccaccggcaagctgcccgtgccctggcccaccctcgtgaccaccctcacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 97 - protein, 199 aa, Artificial
  modif. frag.; CFP F2A, F64L/S65T/Y66W/N146I/M153T mutations
GKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 98 - DNA, 600 bp, Artificial
  modif. frag.; CFP F2A, F64L/S65T/Y66W/N146I/M153T mutations + Met @ posit. 1
  CDS (1)..(600)
atgggcaagctgaccctgaagttcatctgcaccaccggcaagctgcccgtgccctggcccaccctcgtgaccaccctcacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 99 - protein, 200 aa, Artificial
  modif. frag.; CFP F2A, F64L/S65T/Y66W/N146I/M153T mutations + Met @ posit. 1
MGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 100 - DNA, 597 bp, Artificial
  modif. frag.; CFP F2A, V163A mutation
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 101 - protein, 199 aa, Artificial
  modif. frag.; CFP F2A, V163A mutation
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 102 - DNA, 600 bp, Artificial
  modif. frag.; CFP F2A, V163A mutation + Met @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 103 - protein, 200 aa, Artificial
  modif. frag.; CFP F2A, V163A mutation + Met @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 104 - DNA, 597 bp, Artificial
  modif. frag.; CFP F2A, N146I/ V163A mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 105 - protein, 199 aa, Artificial
  modif. frag.; CFP F2A, N146I/ V163A mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYIMADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 106 - DNA, 600 bp, Artificial
  modif. frag.; CFP F2A, N146I/V163A mutations + Met @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 107 - protein, 200 aa, Artificial
  modif. frag.; CFP F2A, N146I/V163A mutations + Met @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYIMADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 108 - DNA, 597 bp, Artificial
  modif. frag.; CFP F2A, M153T/V163A mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 109 - protein, 199 aa, Artificial
  modif. frag.; CFP F2A, M153T/V163A mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 110 - DNA, 600 bp, Artificial
  modif. frag.; CFP F2A, M153T/V163A mutations + Met @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 111 - protein, 200 aa, Artificial
  modif. frag.; CFP F2A, M153T/V163A mutations + Met @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 112 - DNA, 597 bp, Artificial
  modif. frag.; CFP F2A, N146I/M153T/V163A mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 113 - protein, 199 aa, Artificial
  modif. frag.; CFP F2A, N146I/M153T/V163A mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 114 - DNA, 600 bp, Artificial
  modif. frag.; CFP F2A, N146I/M153T/V163A mutations and Met added @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 115 - protein, 200 aa, Artificial
  modif. frag.; CFP F2A, N146I/M153T/V163A mutations and Met added @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 116 - DNA, 597 bp, Artificial
  modif. frag.; CGFP F2A, F46L/S65T/Y66W/N146I/M153T/V163A/T203Y mutations
  CDS (1)..(597)
ggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 117 - protein, 199 aa, Artificial
  modif. frag.; CGFP F2A, F46L/S65T/Y66W/N146I/M153T/V163A/T203Y mutations
GKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 118 - DNA, 600 bp, Artificial
  modif. frag., CGFP F2A, F46L/S65T/Y66W/N146I/M153T/V163A/T203Y mutations and Met added @ posit. 1
  CDS (1)..(600)
atgggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 119 - protein, 200 aa, Artificial
  modif. frag., CGFP F2A, F46L/S65T/Y66W/N146I/M153T/V163A/T203Y mutations and Met added @ posit. 1
MGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 120 - DNA, 597 bp, Artificial
  modif. frag.; CGFP F2A, N146I/T203Y mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 121 - protein, 199 aa, Artificial
  modif. frag.; CGFP F2A, N146I/T203Y mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 122 - DNA, 600 bp, Artificial
  modif. frag.; CGFP F2A, N146I/T203Y mutations + Met @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 123 - protein, 200 aa, Artificial
  modif. frag.; CGFP F2A, N146I/T203Y mutations + Met @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 124 - DNA, 597 bp, Artificial
  modif. frag.; CGFP F2A, M153T/T203Y mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 125 - protein, 199 aa, Artificial
  modif. frag.; CGFP F2A, M153T/T203Y mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 126 - DNA, 600 bp, Artificial
  modif. frag.; CGFP F2A, M153T/T203Y mutations + Met @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 127 - protein, 200 aa, Artificial
  modif. frag.; CGFP F2A, M153T/T203Y mutations + Met @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 128 - DNA, 597 bp, Artificial
  modif. frag.; CGFP F2A,N146I/ M153T/T203Y mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 129 - protein, 199 aa, Artificial
  modif. frag.; CGFP F2A,N146I/ M153T/T203Y mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 130 - DNA, 600 bp, Artificial
  modif. frag.; CGFP F2A,N146I/ M153T/T203Y mutations and Met added @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 131 - protein, 200 aa, Artificial
  modif. frag.; CGFP F2A,N146I/ M153T/T203Y mutations and Met added @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 132 - DNA, 597 bp, Artificial
  modif. frag.; CGFP F2A,F64L/S65T/Y66W/N146I/M153T/T203Y mutations
  CDS (1)..(597)
ggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 133 - protein, 199 aa, Artificial
  modif. frag.; CGFP F2A, F64L/S65T/Y66W/N146I/M153T/T203Y mutations
GKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 134 - DNA, 600 bp, Artificial
  modif. frag.; CGFP F2A, F64L/S65T/Y66W/N146I/M153T/T203Y mutations and Met added @ posit. 1
  CDS (1)..(600)
atgggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 135 - protein, 200 aa, Artificial
  modif. frag.; CGFP F2A, F64L/S65T/Y66W/N146I/M153T/T203Y mutations and Met added @ posit. 1
MGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 136 - DNA, 597 bp, Artificial
  modif. frag.; CGFP F2A, V163A/T203Y mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 137 - protein, 199 aa, Artificial
  modif. frag.; CGFP F2A, V163A/T203Y mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 138 - DNA, 600 bp, Artificial
  modif. frag.; CGFP F2A, V163A/T203Y mutations + Met @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 139 - protein, 200 aa, Artificial
  modif. frag.; CGFP F2A, V163A/T203Y mutations + Met @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 140 - DNA, 597 bp, Artificial
  modif. frag.; CGFP F2A, N146I/V163A/T203Y mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 141 - protein, 199 aa, Artificial
  modif. frag.; CGFP F2A, N146I/V163A/T203Y mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYIMADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 142 - DNA, 600 bp, Artificial
  modif. frag.; CGFP F2A, N146I/V163A/T203Y mutations and Met added @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 143 - protein, 200 aa, Artificial
  modif. frag.; CGFP F2A, N146I/V163A/T203Y mutations and Met added @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYIMADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 144 - DNA, 597 bp, Artificial
  modif. frag.; CGFP F2A, M153T/V163A/T203Y mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 145 - protein, 199 aa, Artificial
  modif. frag.; CGFP F2A, M153T/V163A/T203Y mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 146 - DNA, 600 bp, Artificial
  modif. frag.; CGFP F2A, N146I/V163A/T203Y mutations and Met added @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 147 - protein, 200 aa, Artificial
  modif. frag.; CGFP F2A, N146I/V163A/T203Y mutations and Met added @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 148 - DNA, 597 bp, Artificial
  modif. frag.; CGFP F2A, N146I/M153T/V163A/T203Y mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 149 - protein, 199 aa, Artificial
  modif. frag.; CGFP F2A, N146I/M153T/V163A/T203Y mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 150 - DNA, 600 bp, Artificial
  modif. frag.; CGFP F2A, N146I/M153T/V163A/T203Y mutations and Met added @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 151 - protein, 200 aa, Artificial
  modif. frag.; CGFP F2A, N146I/M153T/V163A/T203Y mutations and Met added @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 152 - DNA, 597 bp, Artificial
  modif. frag.; BFP (blue) F2A, Y66H mutation
  CDS (1)..(597)
ggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 153 - protein, 199 aa, Artificial
  modif. frag.; BFP (blue) F2A, Y66H mutation
GKLTLKFICTTGKLPVPWPTLVTTFGHGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 154 - DNA, 600 bp, Artificial
  modif. frag.; BFP (blue) F2A, Y66H mutation and Met added @ posit. 1
  CDS (1)..(600)
atgggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 155 - protein, 200 aa, Artificial
  modif. frag.; BFP (blue) F2A, Y66H mutation and Met added @ posit. 1
MGKLTLKFICTTGKLPVPWPTLVTTFGHGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 156 - DNA, 597 bp, Artificial
  modif. frag.; BFP (blue) F2A, Y145F mutation
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 157 - protein, 199 aa, Artificial
  modif. frag.; BFP (blue) F2A, Y145F mutation
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 158 - DNA, 600 bp, Artificial
  modif. frag.; BFP (blue) F2A, Y145F mutation and Met added @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 159 - protein, 200 aa, Artificial
  modif. frag.; BFP (blue) F2A, Y145F mutation and Met added @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 160 - DNA, 597 bp, Artificial
  modif. frag.; BFP (blue) F2A, Y66H/Y145F mutations
  CDS (1)..(597)
ggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 161 - protein, 199 aa, Artificial
  modif. frag.; BFP (blue) F2A, Y66H/Y145F mutations
GKLTLKFICTTGKLPVPWPTLVTTFGHGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 162 - DNA, 600 bp, Artificial
  modif. frag.; BFP (blue) F2A, Y66H/Y145F mutations and Met added @ posit. 1
  CDS (1)..(600)
atgggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 163 - protein, 200 aa, Artificial
  modif. frag.; BFP (blue) F2A, Y66H/Y145F mutations and Met added @ posit. 1
MGKLTLKFICTTGKLPVPWPTLVTTFGHGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 164 - DNA, 597 bp, Artificial
  modif. frag.; BFP (blue) F2A,F64L/Y66H/Y145F mutations
  CDS (1)..(597)
ggcaagctgaccctgaagttcatctgcaccaccggcaagctgcccgtgccctggcccaccctcgtgaccaccctgggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 165 - protein, 199 aa, Artificial
  modif. frag.; BFP (blue) F2A,F64L/Y66H/Y145F mutations
GKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 166 - DNA, 600 bp, Artificial
  modif. frag.; BFP F2A, F64L/Y66H/Y145F mutations and Met added @ posit. 1
  CDS (1)..(600)
atgggcaagctgaccctgaagttcatctgcaccaccggcaagctgcccgtgccctggcccaccctcgtgaccaccctgggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 167 - protein, 200 aa, Artificial
  modif. frag.; BFP F2A, F64L/Y66H/Y145F mutations and Met added @ posit. 1
MGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 168 - DNA, 600 bp, Artificial
  modif. frag.; EGFP F2A, with Met added @ posit. 1
  CDS (1)..(600)
atgggcaagctgaccctgaagttcatctgcaccaccggcaagctgcccgtgccctggcccaccctcgtgaccaccctgacctacggcgtgcagtgcttctcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 169 - protein, 200 aa, Artificial
  modif. frag.; EGFP F2A, with  Met added @ posit. 1
MGKLTLKFICTTGKLPVPWPTLVTTLTYGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 170 - DNA, 597 bp, Artificial
  modif. frag.; EGFP emerald F2A, S65T/S72A/N149K/M153T/I167T mutations
  CDS (1)..(597)
ggcaagctgaccctgaagttcatctgcaccaccggcaagctgcccgtgccctggcccaccctcgtgaccaccttcacctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaaggtctatatcaccgccgacaagcagaagaacggcatcaaggtgaacttcaagacccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 171 - protein, 199 aa, Artificial
  modif. frag.; EGFP emerald F2A, S65T/S72A/N149K/M153T/I167T mutations
GKLTLKFICTTGKLPVPWPTLVTTFTYGLQCFARYPDHMKRHDFFKSAMPEGYVQERTIFFKDDGNYKTRAEVKFEGDTLVNRIELKGIDFKEDGNILGHKLEYNYNSHKVYITADKQKNGIKVNFKTRHNIEDGSVQLADHYQQNTPIGDGPVLLPDNHYLSYQSALSKDPNEKRDHMVLLEFVTAAGITLGMDELYK

SEQ ID NO: 172 - DNA, 600 bp, Artificial
  modif. frag.; EGFP emerald F2A,S65T/S72A/N149K/M153T/I167T mutations and Met added @ posit. 1
  CDS (1)..(600)
atgggcaagctgaccctgaagttcatctgcaccaccggcaagctgcccgtgccctggcccaccctcgtgaccaccttcacctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaaggtctatatcaccgccgacaagcagaagaacggcatcaaggtgaacttcaagacccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 173 - protein, 200 aa, Artificial
  modif. frag.; EGFP emerald F2A,S65T/S72A/N149K/M153T/I167T mutations and Met added @ posit. 1
MGKLTLKFICTTGKLPVPWPTLVTTFTYGLQCFARYPDHMKRHDFFKSAMPEGYVQERTIFFKDDGNYKTRAEVKFEGDTLVNRIELKGIDFKEDGNILGHKLEYNYNSHKVYITADKQKNGIKVNFKTRHNIEDGSVQLADHYQQNTPIGDGPVLLPDNHYLSYQSALSKDPNEKRDHMVLLEFVTAAGITLGMDELYK

SEQ ID NO: 174 - DNA, 597 bp, Artificial
  modif. frag.; YFP F2A, Y203F mutation
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 175 - protein, 199 aa, Artificial
  modif. frag.; YFP F2A, Y203F mutation
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSFQSALSKDPNEKRDHMVLLEFVTAAGITLGMDELYK

SEQ ID NO: 176 - DNA, 600 bp, Artificial
  modif. frag.; YFP F2A, Y203F mutation and  Met added @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 177 - protein, 200 aa, Artificial
  modif. frag.; YFP F2A, Y203F mutation and Met added @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSFQSALSKDPNEKRDHMVLLEFVTAAGITLGMDELYK

SEQ ID NO: 178 - DNA, 597 bp, Artificial
  modif. frag.; YFP F2A, Y203H mutation
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 179 - protein, 199 aa, Artificial
  modif. frag.; YFP F2A, Y203H mutation
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSHQSALSKDPNEKRDHMVLLEFVTAAGITLGMDELYK

SEQ ID NO: 180 - DNA, 600 bp, Artificial
  modif. frag.; YFP F2A, Y203H mutation and Met added @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 181 - protein, 200 aa, Artificial
  modif. frag.; YFP F2A, Y203H mutation and Met added @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSHQSALSKDPNEKRDHMVLLEFVTAAGITLGMDELYK

SEQ ID NO: 182 - DNA, 600 bp, Artificial
  modif. frag.; SEYFP F2A frag(aa 40-239 of SEYFP), with Met added @ posit. 1
  CDS (1)..(600)
atgggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 183 - protein, 200 aa, Artificial
  modif. frag.; SEYFP F2A frag(aa 40-239 of SEYFP, with Met added @ posit. 1
MGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 184 - DNA, 597 bp, Artificial
  modif. frag.; Venus F2A, with S175G mutation
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 185 - protein, 199 aa, Artificial
  modif. frag.; Venus F2A, with S175G mutation
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGGVQLADHYQQNTPIGDGPVLLPDNHYLSYQSALSKDPNEKRDHMVLLEFVTAAGITLGMDELYK

SEQ ID NO: 186 - DNA, 600 bp, Artificial
  modif. frag.; Venus F2A, with S175G mutation and Met added @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 187 - protein, 200 aa, Artificial
  modif. frag.; Venus F2A, with S175G mutation and Met added @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGGVQLADHYQQNTPIGDGPVLLPDNHYLSYQSALSKDPNEKRDHMVLLEFVTAAGITLGMDELYK

SEQ ID NO: 188 - DNA, 597 bp, Artificial
  modif. frag.; Venus F2A, with M153T, S175G mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 189 - protein, 199 aa, Artificial
  modif. frag.; Venus F2A, with M153T, S175G mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIEDGGVQLADHYQQNTPIGDGPVLLPDNHYLSYQSALSKDPNEKRDHMVLLEFVTAAGITLGMDELYK

SEQ ID NO: 190 - DNA, 600 bp, Artificial
  modif. frag.; Venus F2A, M153T, S175G mutations and Met added @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 191 - protein, 200 aa, Artificial
  modif.frag.; Venus F2A, M153T, S175G mutations and Met added @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIEDGGVQLADHYQQNTPIGDGPVLLPDNHYLSYQSALSKDPNEKRDHMVLLEFVTAAGITLGMDELYK

SEQ ID NO: 192 - DNA, 597 bp, Artificial
  modif. frag.; Venus F2A, with V163A, S175G mutations
  CDS (1)..(597)
ggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 193 - protein, 199 aa, Artificial
  modif. frag.; Venus F2A, with V163A, S175G mutations
GKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 194 - DNA, 600 bp, Artificial
  modif. frag.; Venus F2A, w. V163A, S175G mutations and Met added @ posit. 1
  CDS (1)..(600)
atgggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 195 - protein, 200 aa, Artificial
  modif. frag.; Venus F2A, w. V163A, S175G mutations and Met added @ posit. 1
MGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 196 - DNA, 597 bp, Artificial
  modif. frag.; Venus F2A,F46L/F64L/M153T/V163A/S175G mutations
  CDS (1)..(597)
ggcaagctgaccctgaagctgatctgcaccaccggcaagctgcccgtgccctggcccaccctcgtgaccaccctcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 197 - protein, 199 aa, Artificial
  modif. frag.; Venus F2A,F46L/F64L/M153T/V163A/S175G mutations
GKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 198 - DNA, 600 bp, Artificial
  modif. frag.; Venus F2A, F46L/F64L/M153T/V163A/S175G mutations and Met added @ posit. 1
  CDS (1)..(600)
atgggcaagctgaccctgaagctgatctgcaccaccggcaagctgcccgtgccctggcccaccctcgtgaccaccctcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 199 - protein, 200 aa, Artificial
  modif. frag.; Venus F2A, F46L/F64L/M153T/V163A/S175G mutations and Met added @ posit. 1
MGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 200 - DNA, 306 bp, Artificial
  modif. frag.; YFP F1B (aa residues 1-103 of YFP) with posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggac

SEQ ID NO: 201 - protein, 102 aa, Artificial
  modif. frag.; YFP F1B (aa residues 1-103 of YFP) with posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKD

SEQ ID NO: 202 - DNA, 309 bp, Artificial
  modif. frag. EGFP F1B, amino acid residue 65 is L, residue 66 is T, residue 69 is V, and residue 73 is S
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcacctacggcgtgcagtgcttcagccgctaccccgaccacatgaagcggcacgacttcttcaagtccgccatgcccgaaggctacgtccaggagcgcaccatcttcttcaaggac

SEQ ID NO: 203 - protein, 103 aa, Artificial
  modif. frag. EGFP F1B, amino acid residue 65 is L, residue 66 is T, residue 69 is V, and residue 73 is S
MVSKGEELFTGVVPILVELDGDVNGHKFSVSGEGEGDATYGKLTLKFICTTGKLPVPWPTLVTTLTYGVQCFSRYPDHMKRHDFFKSAMPEGYVQERTIFFKD

SEQ ID NO: 204 - DNA, 306 bp, Artificial
  modif. frag. EGFP F1B, amino acid residue 65 is L, residue 66 is T, residue 69 is V, residue 73 is S, and posit. 1 Met has been removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcacctacggcgtgcagtgcttcagccgctaccccgaccacatgaagcggcacgacttcttcaagtccgccatgcccgaaggctacgtccaggagcgcaccatcttcttcaaggac

SEQ ID NO: 205 - protein, 102 aa, Artificial
  modif. frag. EGFP F1B, amino acid residue 65 is L, residue 66 is T, residue 69 is V, residue 73 is S, and posit. 1 Met has been removed
VSKGEELFTGVVPILVELDGDVNGHKFSVSGEGEGDATYGKLTLKFICTTGKLPVPWPTLVTTLTYGVQCFSRYPDHMKRHDFFKSAMPEGYVQERTIFFKD

SEQ ID NO: 206 - DNA, 309 bp, Artificial
  modif. frag.;  YFP F1B with K79R mutation
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgcgccggcacgacttcttcaagtccgccatgcccgaaggctacgtccaggagcgcaccatcttcttcaaggac

SEQ ID NO: 207 - protein, 103 aa, Artificial
  modif. frag.;  YFP F1B with K79R mutation
MVSKGEELFTGVVPILVELDGDVNGHKFSVSGEGEGDATYGKLTLKFICTTGKLPVPWPTLVTTFGYGLQCFARYPDHMRRHDFFKSAMPEGYVQERTIFFKD

SEQ ID NO: 208 - DNA, 306 bp, Artificial
  modif. frag.;  YFP F1B  with K79R mutation and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgcgccggcacgacttcttcaagtccgccatgcccgaaggctacgtccaggagcgcaccatcttcttcaaggac

SEQ ID NO: 209 - protein, 102 aa, Artificial
  modif. frag.;  YFP F1B  with K79R mutation and posit. 1 Met removed
VSKGEELFTGVVPILVELDGDVNGHKFSVSGEGEGDATYGKLTLKFICTTGKLPVPWPTLVTTFGYGLQCFARYPDHMRRHDFFKSAMPEGYVQERTIFFKD

SEQ ID NO: 210 - DNA, 309 bp, Artificial
  modif. frag.;  YFP F1B with Y66F mutation
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggac

SEQ ID NO: 211 - protein, 103 aa, Artificial
  modif. frag.;  YFP F1B with Y66F mutation
MVSKGEELFTGVVPILVELDGDVNGHKFSVSGEGEGDATYGKLTLKFICTTGKLPVPWPTLVTTFGFGLQCFARYPDHMKRHDFFKSAMPEGYVQERTIFFKD

SEQ ID NO: 212 - DNA, 306 bp, Artificial
  modif. frag.; YFP F1B  with Y66F mutation and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggac

SEQ ID NO: 213 - protein, 102 aa, Artificial
  modif. frag.; YFP F1B  with Y66F mutation and posit. 1 Met removed
VSKGEELFTGVVPILVELDGDVNGHKFSVSGEGEGDATYGKLTLKFICTTGKLPVPWPTLVTTFGFGLQCFARYPDHMKRHDFFKSAMPEGYVQERTIFFKD

SEQ ID NO: 214 - DNA, 309 bp, Artificial
  modif. frag.;  YFP F1B with Q69K mutation
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggac

SEQ ID NO: 215 - protein, 103 aa, Artificial
  modif. frag.;  YFP F1B with Q69K mutation
MVSKGEELFTGVVPILVELDGDVNGHKFSVSGEGEGDATYGKLTLKFICTTGKLPVPWPTLVTTFGYGLKCFARYPDHMKRHDFFKSAMPEGYVQERTIFFKD

SEQ ID NO: 216 - DNA, 306 bp, Artificial
  modif. frag.;  YFP F1B with Q69K mutation and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggac

SEQ ID NO: 217 - protein, 102 aa, Artificial
  modif. frag.;  YFP F1B with Q69K mutation and posit. 1 Met removed
VSKGEELFTGVVPILVELDGDVNGHKFSVSGEGEGDATYGKLTLKFICTTGKLPVPWPTLVTTFGYGLKCFARYPDHMKRHDFFKSAMPEGYVQERTIFFKD

SEQ ID NO: 218 - DNA, 309 bp, Artificial; identical to SEQ ID NO: 206
  modif. frag.;  YFP F1B with K79R mutation
  CDS (1)..(309)

SEQ ID NO: 219 - protein, 103 aa, Artificial; identical to SEQ ID NO: 207
  modif. frag.;  YFP F1B with K79R mutation

SEQ ID NO: 220 - DNA, 306 bp, Artificial; identical to SEQ ID NO: 208
  modif. frag.;  YFP F1B  with K79R mutation and posit. 1 Met removed
  CDS (1)..(306)

SEQ ID NO: 221 - protein, 102 aa, Artificial; identical to SEQ ID NO: 209
  modif. frag.;  YFP F1B  with K79R mutation and posit. 1 Met removed

SEQ ID NO: 222 - DNA, 309 bp, Artificial
  modif. frag.; citrine F1B, with  V68L, Q69M mutations
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggac

SEQ ID NO: 223 - protein, 103 aa, Artificial
  modif. frag.; citrine F1B, with  V68L, Q69M mutations
MVSKGEELFTGVVPILVELDGDVNGHKFSVSGEGEGDATYGKLTLKFICTTGKLPVPWPTLVTTFGYGLMCFARYPDHMKRHDFFKSAMPEGYVQERTIFFKD

SEQ ID NO: 224 - DNA, 306 bp, Artificial
  modif. frag.; citrine F1B, with  V68L, Q69M mutations and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggac

SEQ ID NO: 225 - protein, 102 aa, Artificial
  modif. frag.; citrine F1B, with  V68L, Q69M mutations and posit. 1 Met removed
VSKGEELFTGVVPILVELDGDVNGHKFSVSGEGEGDATYGKLTLKFICTTGKLPVPWPTLVTTFGYGLMCFARYPDHMKRHDFFKSAMPEGYVQERTIFFKD

SEQ ID NO: 226 - DNA, 309 bp, Artificial
  modif. frag.; Venus F1B with F46L, F64L mutations
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggac

SEQ ID NO: 227 - protein, 103 aa, Artificial
  modif. frag.; Venus F1B with F46L, F64L mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKD

SEQ ID NO: 228 - DNA, 306 bp, Artificial
  modif. frag.; Venus F1B with F46L, F64L mutations and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggac

SEQ ID NO: 229 - protein, 102 aa, Artificial
  modif. frag.; Venus F1B with F46L, F64L mutations and posit. 1 Met removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKD

SEQ ID NO: 230 - DNA, 309 bp, Artificial
  modif. frag.;  YFP F1B with F46L mutation
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggac

SEQ ID NO: 231 - protein, 103 aa, Artificial
  modif. frag.;  YFP F1B with F46L mutation
MVSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKD

SEQ ID NO: 232 - DNA, 306 bp, Artificial
  modif. frag.;  YFP F1B with F46L mutation and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggac

SEQ ID NO: 233 - protein, 102 aa, Artificial
  modif. frag.;  YFP F1B with F46L mutation and posit. 1 Met removed
VSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKD

SEQ ID NO: 234 - DNA, 309 bp, Artificial
  modif. frag.; CFP F1B with F64L mutation
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggac

SEQ ID NO: 235 - protein, 103 aa, Artificial
  modif. frag.; CFP F1B with F64L mutation
MVSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKD

SEQ ID NO: 236 - DNA, 306 bp, Artificial
  modif. frag.; CFP F1B with F64L mutation and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggac

SEQ ID NO: 237 - protein, 102 aa, Artificial
  modif. frag.; CFP F1B with F64L mutation and posit. 1 Met removed
VSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKD

SEQ ID NO: 238 - DNA, 309 bp, Artificial
  modif. frag.; CFP F1B with Y66W  mutation
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggac

SEQ ID NO: 239 - protein, 103 aa, Artificial
  modif. frag.; CFP F1B with Y66W  mutation
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKD

SEQ ID NO: 240 - DNA, 306 bp, Artificial
  modif. frag.; CFP F1B with Y66W mutation and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggac

SEQ ID NO: 241 - protein, 102 aa, Artificial
  modif. frag.; CFP F1B with Y66W mutation and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKD

SEQ ID NO: 242 - DNA, 309 bp, Artificial
  modif. frag.; CFP F1B with S65A  mutation
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggac

SEQ ID NO: 243 - protein, 103 aa, Artificial
  modif. frag.; CFP F1B with S65A  mutation
MVSKGEELFTGVVPILVELDGDVNGHKFSVSGEGEGDATYGKLTLKFICTTGKLPVPWPTLVTTFAYGLQCFARYPDHMKRHDFFKSAMPEGYVQERTIFFKD

SEQ ID NO: 244 - DNA, 306 bp, Artificial
  modif. frag.; CFP F1B with S65A mutation and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggac

SEQ ID NO: 245 - protein, 102 aa, Artificial
  modif. frag.; CFP F1B with S65A mutation and posit. 1 Met removed
VSKGEELFTGVVPILVELDGDVNGHKFSVSGEGEGDATYGKLTLKFICTTGKLPVPWPTLVTTFAYGLQCFARYPDHMKRHDFFKSAMPEGYVQERTIFFKD

SEQ ID NO: 246 - DNA, 309 bp, Artificial
  modif. frag.; CFP F1B, S65A, Y66W, and S72A mutations
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggac

SEQ ID NO: 247 - protein, 103 aa, Artificial
  modif. frag.; CFP F1B, S65A, Y66W, and S72A mutations
MVSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKD

SEQ ID NO: 248 - DNA, 306 bp, Artificial
  modif. frag.; CFP F1B, S65A,Y66W,and S72A mutations, and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggac

SEQ ID NO: 249 - protein, 102 aa, Artificial
  modif. frag.; CFP F1B, S65A,Y66W,and S72A mutations, and posit. 1 Met removed
VSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKD

SEQ ID NO: 250 - DNA, 309 bp, Artificial
  modif. frag.; CFP F1B,F64L ,S65T, and Y66W mutations
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcacctggggcctgcagtgcttcgcccgctaccccgaccacatgaagcggcacgacttcttcaagtccgccatgcccgaaggctacgtccaggagcgcaccatcttcttcaaggac

SEQ ID NO: 251 - protein, 103 aa, Artificial
  modif. frag.; CFP F1B,F64L ,S65T, and Y66W mutations
MVSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKD

SEQ ID NO: 252 - DNA, 306 bp, Artificial
  modif. frag.; CFP F1B,F64L ,S65T, and Y66W mutations, and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcacctggggcctgcagtgcttcgcccgctaccccgaccacatgaagcggcacgacttcttcaagtccgccatgcccgaaggctacgtccaggagcgcaccatcttcttcaaggac

SEQ ID NO: 253 - protein, 102 aa, Artificial
  modif. frag.; CFP F1B,F64L ,S65T, and Y66W mutations, and posit. 1 Met removed
VSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKD

SEQ ID NO: 254 - DNA, 309 bp, Artificial
  modif. frag.; BFP F1B, with Y66H mutation
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggac

SEQ ID NO: 255 - protein, 103 aa, Artificial
  modif. frag.; BFP F1B, with Y66H mutation
MVSKGEELFTGVVPILVELDGDVNGHKFSVSGEGEGDATYGKLTLKFICTTGKLPVPWPTLVTTFGHGLQCFARYPDHMKRHDFFKSAMPEGYVQERTIFFKD

SEQ ID NO: 256 - DNA, 306 bp, Artificial
  modif. frag.; BFP F1B, with Y66H mutation and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggac

SEQ ID NO: 257 - protein, 102 aa, Artificial
  modif. frag.; BFP F1B, with Y66H mutation and posit. 1 Met removed
VSKGEELFTGVVPILVELDGDVNGHKFSVSGEGEGDATYGKLTLKFICTTGKLPVPWPTLVTTFGHGLQCFARYPDHMKRHDFFKSAMPEGYVQERTIFFKD

SEQ ID NO: 258 - DNA, 309 bp, Artificial
  modif. frag.; BFP F1B, with F64L, Y66H mutations
  CDS (1)..(309)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggccacggcctgcagtgcttcgcccgctaccccgaccacatgaagcggcacgacttcttcaagtccgccatgcccgaaggctacgtccaggagcgcaccatcttcttcaaggac

SEQ ID NO: 259 - protein, 103 aa, Artificial
  modif. frag.; BFP F1B, with F64L, Y66H mutations
MVSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKD

SEQ ID NO: 260 - DNA, 306 bp, Artificial
  modif. frag.; BFP F1B, with F64L, Y66H mutations and posit. 1 Met removed
  CDS (1)..(306)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggccacggcctgcagtgcttcgcccgctaccccgaccacatgaagcggcacgacttcttcaagtccgccatgcccgaaggctacgtccaggagcgcaccatcttcttcaaggac

SEQ ID NO: 261 - protein, 102 aa, Artificial
  modif. frag.; BFP F1B, with F64L, Y66H mutations and posit. 1 Met removed
VSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKD

SEQ ID NO: 262 - DNA, 411 bp, Artificial
  modif. frag.; YFP F2B (aa residues 104-240 of EYFP) and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 263 - protein, 137 aa, Artificial
  modif. frag.; YFP F2B (aa residues 104-240 of EYFP) and Met added @ posit. 1
MDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 264 - DNA, 408 bp, Artificial
  modif. frag.; EGFP F2B(emerald), N146K, M153T, and I167T mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaaggtctatatcaccgccgacaagcagaagaacggcatcaaggtgaacttcaagacccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 265 - protein, 136 aa, Artificial
  modif. frag.; EGFP F2B(emerald), N146K, M153T, and I167T mutations
DGNYKTRAEVKFEGDTLVNRIELKGIDFKEDGNILGHKLEYNYNSHKVYITADKQKNGIKVNFKTRHNIEDGSVQLADHYQQNTPIGDGPVLLPDNHYLSTQSALSKDPNEKRDHMVLLEFVTAAGITLGMDELYK

SEQ ID NO: 266 - DNA, 411 bp, Artificial
  modif. frag.; EGFP F2B(emerald), N146K, M153T, and I167T mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaaggtctatatcaccgccgacaagcagaagaacggcatcaaggtgaacttcaagacccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 267 - protein, 137 aa, Artificial
  modif. frag.; EGFP F2B(emerald), N146K, M153T, and I167T mutations and Met added @ posit. 1
MDGNYKTRAEVKFEGDTLVNRIELKGIDFKEDGNILGHKLEYNYNSHKVYITADKQKNGIKVNFKTRHNIEDGSVQLADHYQQNTPIGDGPVLLPDNHYLSTQSALSKDPNEKRDHMVLLEFVTAAGITLGMDELYK

SEQ ID NO: 268 - DNA, 408 bp, Artificial
  modif. frag.; YFP F2B with Y203F mutation
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 269 - protein, 136 aa, Artificial
  modif. frag.; YFP F2B with Y203F mutation
DGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSFQSALSKDPNEKRDHMVLLEFVTAAGITLGMDELYK

SEQ ID NO: 270 - DNA, 411 bp, Artificial
  modif. frag.; YFP F2B with Y203F mutation + Met @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 271 - protein, 137 aa, Artificial
  modif. frag.; YFP F2B with Y203F mutation + Met @ posit. 1
MDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSFQSALSKDPNEKRDHMVLLEFVTAAGITLGMDELYK

SEQ ID NO: 272 - DNA, 408 bp, Artificial
  modif. frag.; YFP F2B with Y203H mutation
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 273 - protein, 136 aa, Artificial
  modif. frag.; YFP F2B with Y203H mutation
DGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSHQSALSKDPNEKRDHMVLLEFVTAAGITLGMDELYK

SEQ ID NO: 274 - DNA, 411 bp, Artificial
  modif. frag.; YFP F2B with Y203H mutation + Met @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 275 - protein, 137 aa, Artificial
  modif. frag.; YFP F2B with Y203H mutation + Met @ posit. 1
MDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSHQSALSKDPNEKRDHMVLLEFVTAAGITLGMDELYK

SEQ ID NO: 276 - DNA, 408 bp, Artificial
  modif. frag.; CFP F2B with N146I mutation
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 277 - protein, 136 aa, Artificial
  modif. frag.; CFP F2B with N146I mutation
DGNYKTRAEVKFEGDTLVNRIELKGIDFKEDGNILGHKLEYNYISHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 278 - DNA, 411 bp, Artificial
  modif. frag.; CFP F2B w. N146I mutation and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 279 - protein, 137 aa, Artificial
  modif. frag.; CFP F2B w. N146I mutation and Met added @ posit. 1
MDGNYKTRAEVKFEGDTLVNRIELKGIDFKEDGNILGHKLEYNYISHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 280 - DNA, 408 bp, Artificial
  modif. frag.; CFP F2B with M153T mutation
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcactgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 281 - protein, 136 aa, Artificial
  modif. frag.; CFP F2B with M153T mutation
DGNYKTRAEVKFEGDTLVNRIELKGIDFKEDGNILGHKLEYNYNSHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 282 - DNA, 411 bp, Artificial
  modif. frag.; CFP F2B w. M153T mutation and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcactgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 283 - protein, 137 aa, Artificial
  modif. frag.; CFP F2B w. M153T mutation and Met added @ posit. 1
MDGNYKTRAEVKFEGDTLVNRIELKGIDFKEDGNILGHKLEYNYNSHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 284 - DNA, 408 bp, Artificial
  modif. frag.; CFP F2B with N146I, M153T mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 285 - protein, 136 aa, Artificial
  modif. frag.; CFP F2B with N146I, M153T mutations
DGNYKTRAEVKFEGDTLVNRIELKGIDFKEDGNILGHKLEYNYISHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 286 - DNA, 411 bp, Artificial
  modif. frag.; CFP F2B with N146I, M153T mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 287 - protein, 137 aa, Artificial
  modif. frag.; CFP F2B with N146I, M153T mutations and Met added @ posit. 1
MDGNYKTRAEVKFEGDTLVNRIELKGIDFKEDGNILGHKLEYNYISHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 288 - DNA, 408 bp, Artificial
  modif. frag.; CFP F2B with V163A  mutation
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 289 - protein, 136 aa, Artificial
  modif. frag.; CFP F2B with V163A  mutation
DGNYKTRAEVKFEGDTLVNRIELKGIDFKEDGNILGHKLEYNYNSHNVYIMADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 290 - DNA, 411 bp, Artificial
  modif. frag.; CFP F2B w. V163A mutation and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 291 - protein, 137 aa, Artificial
  modif. frag.; CFP F2B w. V163A mutation and Met added @ posit. 1
MDGNYKTRAEVKFEGDTLVNRIELKGIDFKEDGNILGHKLEYNYNSHNVYIMADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 292 - DNA, 408 bp, Artificial
  modif. frag.; CFP F2B with N146I, V163A mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcactcagtccgccctgagcaaagaccccaacgagaagcgcgatcacatggtcctgctggagttcgtgaccgccgccgggatcactctcggcatggacgagctgtacaag

SEQ ID NO: 293 - protein, 136 aa, Artificial
  modif. frag.; CFP F2B with N146I, V163A mutations
DGNYKTRAEVKFEGDTLVNRIELKGIDFKEDGNILGHKLEYNYISHNVYIMADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 294 - DNA, 411 bp, Artificial
  modif. frag.; CFP F2B with N146I, V163A mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcactcagtccgccctgagcaaagaccccaacgagaagcgcgatcacatggtcctgctggagttcgtgaccgccgccgggatcactctcggcatggacgagctgtacaag

SEQ ID NO: 295 - protein, 137 aa, Artificial
  modif. frag.; CFP F2B with N146I, V163A mutations and Met added @ posit. 1
MDGNYKTRAEVKFEGDTLVNRIELKGIDFKEDGNILGHKLEYNYISHNVYIMADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 296 - DNA, 408 bp, Artificial
  modif. frag.; CFP F2B with M153T,  V163A  mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcactcagtccgccctgagcaaagaccccaacgagaagcgcgatcacatggtcctgctggagttcgtgaccgccgccgggatcactctcggcatggacgagctgtacaag

SEQ ID NO: 297 - protein, 136 aa, Artificial
  modif. frag.; CFP F2B with M153T,  V163A  mutations
DGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 298 - DNA, 411 bp, Artificial
  modif. frag.; CFP F2B with M153T, V163A  mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcactcagtccgccctgagcaaagaccccaacgagaagcgcgatcacatggtcctgctggagttcgtgaccgccgccgggatcactctcggcatggacgagctgtacaag

SEQ ID NO: 299 - protein, 137 aa, Artificial
  modif. frag.; CFP F2B with M153T, V163A  mutations and Met added @ posit. 1
MDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 300 - DNA, 408 bp, Artificial
  modif. frag.; CFP F2B , N146I, M153T, and V163A mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 301 - protein, 136 aa, Artificial
  modif. frag.; CFP F2B , N146I, M153T, and V163A mutations
DGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 302 - DNA, 411 bp, Artificial
  modif. frag.; CFP F2B, N146I, M153T, and V163A mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 303 - protein, 137 aa, Artificial
  modif. frag.; CFP F2B, N146I, M153T, and V163A mutations and Met added @ posit. 1
MDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 304 - DNA, 408 bp, Artificial
  modif. frag.; CGFP F2B, w. N146I, T203Y mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 305 - protein, 136 aa, Artificial
  modif. frag.; CGFP F2B, w. N146I, T203Y mutations
DGNYKTRAEVKFEGDTLVNRIELKGIDFKEDGNILGHKLEYNYISHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 306 - DNA, 411 bp, Artificial
  modif. frag.; CGFP F2B, w. N146I, T203Y mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 307 - protein, 137 aa, Artificial
  modif. frag.; CGFP F2B, w. N146I, T203Y mutations and Met added @ posit. 1
MDGNYKTRAEVKFEGDTLVNRIELKGIDFKEDGNILGHKLEYNYISHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 308 - DNA, 408 bp, Artificial
  modif. frag.; CGFP F2B, w. M153T, T203Y mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 309 - protein, 136 aa, Artificial
  modif. frag.; CGFP F2B, w. M153T, T203Y mutations
DGNYKTRAEVKFEGDTLVNRIELKGIDFKEDGNILGHKLEYNYNSHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 310 - DNA, 411 bp, Artificial
  modif. frag.; CGFP F2B, w. M153T, T203Y mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 311 - protein, 137 aa, Artificial
  modif. frag.; CGFP F2B, w. M153T, T203Y mutations and Met added @ posit. 1
MDGNYKTRAEVKFEGDTLVNRIELKGIDFKEDGNILGHKLEYNYNSHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 312 - DNA, 408 bp, Artificial
  modif. frag.; CGFP F2B, N146I, M153T, and T203Y mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 313 - protein, 136 aa, Artificial
  modif. frag.; CGFP F2B, N146I, M153T, and T203Y mutations
DGNYKTRAEVKFEGDTLVNRIELKGIDFKEDGNILGHKLEYNYISHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 314 - DNA, 411 bp, Artificial
  modif. frag.; CGFP F2B,N146I, M153T, and T203Y mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 315 - protein, 137 aa, Artificial
  modif. frag.; CGFP F2B,N146I, M153T, and T203Y mutations and Met added @ posit. 1
MDGNYKTRAEVKFEGDTLVNRIELKGIDFKEDGNILGHKLEYNYISHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 316 - DNA, 408 bp, Artificial
  modif. frag.; CGFP F2B, w. V163A, T203Y mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 317 - protein, 136 aa, Artificial
  modif. frag.; CGFP F2B, w. V163A, T203Y mutations
DGNYKTRAEVKFEGDTLVNRIELKGIDFKEDGNILGHKLEYNYNSHNVYIMADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 318 - DNA, 411 bp, Artificial
  modif. frag.; CGFP F2B, w. V163A, T203Y mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 319 - protein, 137 aa, Artificial
  modif. frag.; CGFP F2B, w. V163A, T203Y mutations and Met added @ posit. 1
MDGNYKTRAEVKFEGDTLVNRIELKGIDFKEDGNILGHKLEYNYNSHNVYIMADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 320 - DNA, 408 bp, Artificial
  modif. frag.; CGFP F2B,N146I, V163A, and T203Y mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 321 - protein, 136 aa, Artificial
  modif. frag.; CGFP F2B,N146I, V163A, and T203Y mutations
DGNYKTRAEVKFEGDTLVNRIELKGIDFKEDGNILGHKLEYNYISHNVYIMADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 322 - DNA, 411 bp, Artificial
  modif. frag.; CGFP F2B, N146I,V163A, and T203Y mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 323 - protein, 137 aa, Artificial
  modif. frag.; CGFP F2B, N146I,V163A, and T203Y mutations and Met added @ posit. 1
MDGNYKTRAEVKFEGDTLVNRIELKGIDFKEDGNILGHKLEYNYISHNVYIMADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 324 - DNA, 408 bp, Artificial
  modif. frag.; CGFP F2B, M153T, V163A, and T203Y mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 325 - protein, 136 aa, Artificial
  modif. frag.; CGFP F2B, M153T, V163A, and T203Y mutations
DGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 326 - DNA, 411 bp, Artificial
  modif. frag.; CGFP F2B, M153T, V163A, and T203Y mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 327 - protein, 137 aa, Artificial
  modif. frag.; CGFP F2B, M153T, V163A, and T203Y mutations and Met added @ posit. 1
MDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 328 - DNA, 408 bp, Artificial
  modif. frag.; CGFP F2B, N146I, M153T, V163A, and T203Y mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 329 - protein, 136 aa, Artificial
  modif. frag.; CGFP F2B, N146I, M153T, V163A, and T203Y mutations
DGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 330 - DNA, 411 bp, Artificial
  modif. frag.; CGFP F2B, N146I, M153T, V163A, and T203Y mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 331 - protein, 137 aa, Artificial
  modif. frag.; CGFP F2B, N146I, M153T, V163A, and T203Y mutations and Met added @ posit. 1
MDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 332 - DNA, 408 bp, Artificial
  modif. frag.; BFP F2B with Y145F mutation
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 333 - protein, 136 aa, Artificial
  modif. frag.; BFP F2B with Y145F mutation
DGNYKTRAEVKFEGDTLVNRIELKGIDFKEDGNILGHKLEYNFNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 334 - DNA, 411 bp, Artificial
  modif. frag.; BFP F2B w. Y145F mutation and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 335 - protein, 137 aa, Artificial
  modif. frag.; BFP F2B w. Y145F mutation and Met added @ posit. 1
MDGNYKTRAEVKFEGDTLVNRIELKGIDFKEDGNILGHKLEYNFNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 336 - DNA, 408 bp, Artificial
  modif. frag.; Venus F2B with S175G mutation
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 337 - protein, 136 aa, Artificial
  modif. frag.; Venus F2B with S175G mutation
DGNYKTRAEVKFEGDTLVNRIELKGIDFKEDGNILGHKLEYNYNSHNVYIMADKQKNGIKVNFKIRHNIEDGGVQLADHYQQNTPIGDGPVLLPDNHYLSYQSALSKDPNEKRDHMVLLEFVTAAGITLGMDELYK

SEQ ID NO: 338 - DNA, 411 bp, Artificial
  modif. frag.; Venus F2B with S175G mutation and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 339 - protein, 137 aa, Artificial
  modif. frag.; Venus F2B with S175G mutation and Met added @ posit. 1
MDGNYKTRAEVKFEGDTLVNRIELKGIDFKEDGNILGHKLEYNYNSHNVYIMADKQKNGIKVNFKIRHNIEDGGVQLADHYQQNTPIGDGPVLLPDNHYLSYQSALSKDPNEKRDHMVLLEFVTAAGITLGMDELYK

SEQ ID NO: 340 - DNA, 408 bp, Artificial
  modif. frag.; Venus F2B w. M153T, S175G mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 341 - protein, 136 aa, Artificial
  modif. frag.; Venus F2B w. M153T, S175G mutations
DGNYKTRAEVKFEGDTLVNRIELKGIDFKEDGNILGHKLEYNYNSHNVYITADKQKNGIKVNFKIRHNIEDGGVQLADHYQQNTPIGDGPVLLPDNHYLSYQSALSKDPNEKRDHMVLLEFVTAAGITLGMDELYK

SEQ ID NO: 342 - DNA, 411 bp, Artificial
  modif. frag.; Venus F2B w. M153T, S175G mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 343 - protein, 137 aa, Artificial
  modif. frag.; Venus F2B w. M153T, S175G mutations and Met added @ posit. 1
MDGNYKTRAEVKFEGDTLVNRIELKGIDFKEDGNILGHKLEYNYNSHNVYITADKQKNGIKVNFKIRHNIEDGGVQLADHYQQNTPIGDGPVLLPDNHYLSYQSALSKDPNEKRDHMVLLEFVTAAGITLGMDELYK

SEQ ID NO: 344 - DNA, 408 bp, Artificial
  modif. frag.; Venus F2B w. V163A,  S175G mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 345 - protein, 136 aa, Artificial
  modif. frag.; Venus F2B w. V163A,  S175G mutations
DGNYKTRAEVKFEGDTLVNRIELKGIDFKEDGNILGHKLEYNYNSHNVYIMADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 346 - DNA, 411 bp, Artificial
  modif. frag.; Venus F2B w. V163A, S175G mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 347 - protein, 137 aa, Artificial
  modif. frag.; Venus F2B w. V163A, S175G mutations and Met added @ posit. 1
MDGNYKTRAEVKFEGDTLVNRIELKGIDFKEDGNILGHKLEYNYNSHNVYIMADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 348 - DNA, 408 bp, Artificial
  modif. frag.; Venus F2B, M153T, V163A, S175G mutations
  CDS (1)..(408)
gacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 349 - protein, 136 aa, Artificial
  modif. frag.; Venus F2B, M153T, V163A, S175G mutations
DGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 350 - DNA, 411 bp, Artificial
  modif. frag.; Venus F2B, M153T, V163A, S175G mutations and Met added @ posit. 1
  CDS (1)..(411)
atggacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 351 - protein, 137 aa, Artificial
  modif. frag.; Venus F2B, M153T, V163A, S175G mutations and Met added @ posit. 1
MDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 352 - DNA, 348 bp, Artificial
  modif. frag.; YFP F1C (aa residues 1-117 of EYFP) with posit.1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 353 - protein, 116 aa, Artificial
  modif. frag.; YFP F1C (aa residues 1-117 of EYFP) with posit.1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEG

SEQ ID NO: 354 - DNA, 351 bp, Artificial
  modif. frag.; YFP F1C, with F46L mutation
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 355 - protein, 117 aa, Artificial
  modif. frag.; YFP F1C, with F46L mutation
MVSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEG

SEQ ID NO: 356 - DNA, 348 bp, Artificial
  modif. frag.; YFP F1C w. F46L mutation & posit. 1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 357 - protein, 116 aa, Artificial
  modif. frag.; YFP F1C w. F46L mutation & posit. 1 Met removed
VSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEG

SEQ ID NO: 358 - DNA, 351 bp, Artificial
  modif. frag.; YFP F1C with K79R mutation
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgcgccggcacgacttcttcaagtccgccatgcccgaaggctacgtccaggagcgcaccatcttcttcaaggacgacggcaactacaagacccgcgccgaggtgaagttcgagggc

SEQ ID NO: 359 - protein, 117 aa, Artificial
  modif. frag.; YFP F1C with K79R mutation
MVSKGEELFTGVVPILVELDGDVNGHKFSVSGEGEGDATYGKLTLKFICTTGKLPVPWPTLVTTFGYGLQCFARYPDHMRRHDFFKSAMPEGYVQERTIFFKDDGNYKTRAEVKFEG

SEQ ID NO: 360 - DNA, 348 bp, Artificial
  modif. frag.; YFP F1C  w. K79R mutation & posit. 1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgcgccggcacgacttcttcaagtccgccatgcccgaaggctacgtccaggagcgcaccatcttcttcaaggacgacggcaactacaagacccgcgccgaggtgaagttcgagggc

SEQ ID NO: 361 - protein, 116 aa, Artificial
  modif. frag.; YFP F1C  w. K79R mutation & posit. 1 Met removed
VSKGEELFTGVVPILVELDGDVNGHKFSVSGEGEGDATYGKLTLKFICTTGKLPVPWPTLVTTFGYGLQCFARYPDHMRRHDFFKSAMPEGYVQERTIFFKDDGNYKTRAEVKFEG

SEQ ID NO: 362 - DNA, 351 bp, Artificial
  modif. frag.; YFP F1C  with Y66F mutation
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 363 - protein, 117 aa, Artificial
  modif. frag.; YFP F1C  with Y66F mutation
MVSKGEELFTGVVPILVELDGDVNGHKFSVSGEGEGDATYGKLTLKFICTTGKLPVPWPTLVTTFGFGLQCFARYPDHMKRHDFFKSAMPEGYVQERTIFFKDDGNYKTRAEVKFEG

SEQ ID NO: 364 - DNA, 348 bp, Artificial
  modif. frag.; YFP F1C w. Y66F mutation & posit. 1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 365 - protein, 116 aa, Artificial
  modif. frag.; YFP F1C w. Y66F mutation & posit. 1 Met removed
VSKGEELFTGVVPILVELDGDVNGHKFSVSGEGEGDATYGKLTLKFICTTGKLPVPWPTLVTTFGFGLQCFARYPDHMKRHDFFKSAMPEGYVQERTIFFKDDGNYKTRAEVKFEG

SEQ ID NO: 366 - DNA, 351 bp, Artificial
  modif. frag.; YFP F1C  with Q69K mutation
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 367 - protein, 117 aa, Artificial
  modif. frag.; YFP F1C  with Q69K mutation
MVSKGEELFTGVVPILVELDGDVNGHKFSVSGEGEGDATYGKLTLKFICTTGKLPVPWPTLVTTFGYGLKCFARYPDHMKRHDFFKSAMPEGYVQERTIFFKDDGNYKTRAEVKFEG

SEQ ID NO: 368 - DNA, 348 bp, Artificial
  modif. frag.; YFP F1C w. Q69K mutation & posit. 1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 369 - protein, 116 aa, Artificial
  modif. frag.; YFP F1C w. Q69K mutation & posit. 1 Met removed
VSKGEELFTGVVPILVELDGDVNGHKFSVSGEGEGDATYGKLTLKFICTTGKLPVPWPTLVTTFGYGLKCFARYPDHMKRHDFFKSAMPEGYVQERTIFFKDDGNYKTRAEVKFEG

SEQ ID NO: 370 - DNA, 351 bp, Artificial
  modif. frag.; citrine F1C w. V68L, Q69M mutations
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 371 - protein, 117 aa, Artificial
  modif. frag.; citrine F1C w. V68L, Q69M mutations
MVSKGEELFTGVVPILVELDGDVNGHKFSVSGEGEGDATYGKLTLKFICTTGKLPVPWPTLVTTFGYGLMCFARYPDHMKRHDFFKSAMPEGYVQERTIFFKDDGNYKTRAEVKFEG

SEQ ID NO: 372 - DNA, 348 bp, Artificial
  modif. frag.; citrine  F1C  w. V68L, Q69M mutations & posit. 1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 373 - protein, 116 aa, Artificial
  modif. frag.; citrine  F1C  w. V68L, Q69M mutations & posit. 1 Met removed
VSKGEELFTGVVPILVELDGDVNGHKFSVSGEGEGDATYGKLTLKFICTTGKLPVPWPTLVTTFGYGLMCFARYPDHMKRHDFFKSAMPEGYVQERTIFFKDDGNYKTRAEVKFEG

SEQ ID NO: 374 - DNA, 351 bp, Artificial
  modif. frag.; YFP F1C  w. F46L, F64L  mutations
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 375 - protein, 117 aa, Artificial
  modif. frag.; YFP F1C  w. F46L, F64L  mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEG

SEQ ID NO: 376 - DNA, 348 bp, Artificial
  modif. frag.; YFP F1C  w. F46L, F64L mutations & posit.1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 377 - protein, 116 aa, Artificial
  modif. frag.; YFP F1C  w. F46L, F64L mutations & posit.1 Met removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEG

SEQ ID NO: 378 - DNA, 351 bp, Artificial
  modif. frag.; CFP F1C  w. F64L mutation
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 379 - protein, 117 aa, Artificial
  modif. frag.; CFP F1C  w. F64L mutation
MVSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEG

SEQ ID NO: 380 - DNA, 348 bp, Artificial
  modif. frag.;CFP F1C w. F64L mutation & posit. 1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 381 - protein, 116 aa, Artificial
  modif. frag.;CFP F1C w. F64L mutation & posit. 1 Met removed
VSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEG

SEQ ID NO: 382 - DNA, 351 bp, Artificial
  modif. frag.; CFP F1C with Y66W mutation
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 383 - protein, 117 aa, Artificial
  modif. frag.; CFP F1C with Y66W mutation
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEG

SEQ ID NO: 384 - DNA, 348 bp, Artificial
  modif. frag.; CFP F1C w. Y66W mutation & posit. 1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 385 - protein, 116 aa, Artificial
  modif. frag.; CFP F1C w. Y66W mutation & posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEG

SEQ ID NO: 386 - DNA, 351 bp, Artificial
  modif. frag.; CFP F1C  with S65A  mutation
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 387 - protein, 117 aa, Artificial
  modif. frag.; CFP F1C  with S65A  mutation
MVSKGEELFTGVVPILVELDGDVNGHKFSVSGEGEGDATYGKLTLKFICTTGKLPVPWPTLVTTFAYGLQCFARYPDHMKRHDFFKSAMPEGYVQERTIFFKDDGNYKTRAEVKFEG

SEQ ID NO: 388 - DNA, 348 bp, Artificial
  modif. frag.; CFP F1C w. S65A mutation & posit. 1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 389 - protein, 116 aa, Artificial
  modif. frag.; CFP F1C w. S65A mutation & posit. 1 Met removed
VSKGEELFTGVVPILVELDGDVNGHKFSVSGEGEGDATYGKLTLKFICTTGKLPVPWPTLVTTFAYGLQCFARYPDHMKRHDFFKSAMPEGYVQERTIFFKDDGNYKTRAEVKFEG

SEQ ID NO: 390 - DNA, 351 bp, Artificial
  modif. frag.; CFP F1C ,S65A, Y66W, and S72A mutations
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 391 - protein, 117 aa, Artificial
  modif. frag.; CFP F1C ,S65A, Y66W, and S72A mutations
MVSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEG

SEQ ID NO: 392 - DNA, 348 bp, Artificial
  modif. frag.; CFP F1C , S65A, Y66W, and S72A mutations & posit. 1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 393 - protein, 116 aa, Artificial
  modif. frag.; CFP F1C , S65A, Y66W, and S72A mutations & posit. 1 Met removed
VSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEG

SEQ ID NO: 394 - DNA, 351 bp, Artificial
  modif. frag.; CFP F1C , F64L, S65T, and Y66W mutations
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 395 - protein, 117 aa, Artificial
  modif. frag.; CFP F1C , F64L, S65T, and Y66W mutations
MVSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEG

SEQ ID NO: 396 - DNA, 348 bp, Artificial
  modif. frag.; CFP F1C ,F64L, S65T, and Y66W mutations & posit. 1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggc

SEQ ID NO: 397 - protein, 116 aa, Artificial
  modif. frag.; CFP F1C ,F64L, S65T, and Y66W mutations & posit. 1 Met removed
VSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEG

SEQ ID NO: 398 - DNA, 351 bp, Artificial
  modif. frag.;  BFP F1C with Y66H mutation
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggccacggcctgcagtgcttcgcccgctaccccgaccacatgcgccggcacgacttcttcaagtccgccatgcccgaaggctacgtccaggagcgcaccatcttcttcaaggacgacggcaactacaagacccgcgccgaggtgaagttcgagggc

SEQ ID NO: 399 - protein, 117 aa, Artificial
  modif. frag.;  BFP F1C with Y66H mutation
MVSKGEELFTGVVPILVELDGDVNGHKFSVSGEGEGDATYGKLTLKFICTTGKLPVPWPTLVTTFGHGLQCFARYPDHMRRHDFFKSAMPEGYVQERTIFFKDDGNYKTRAEVKFEG

SEQ ID NO: 400 - DNA, 348 bp, Artificial
  modif. frag.; BFP F1C w. Y66H mutation & posit. 1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggccacggcctgcagtgcttcgcccgctaccccgaccacatgcgccggcacgacttcttcaagtccgccatgcccgaaggctacgtccaggagcgcaccatcttcttcaaggacgacggcaactacaagacccgcgccgaggtgaagttcgagggc

SEQ ID NO: 401 - protein, 116 aa, Artificial
  modif. frag.; BFP F1C w. Y66H mutation & posit. 1 Met removed
VSKGEELFTGVVPILVELDGDVNGHKFSVSGEGEGDATYGKLTLKFICTTGKLPVPWPTLVTTFGHGLQCFARYPDHMRRHDFFKSAMPEGYVQERTIFFKDDGNYKTRAEVKFEG

SEQ ID NO: 402 - DNA, 351 bp, Artificial
  modif. frag.;  BFP F1C w. F64L, Y66H mutations
  CDS (1)..(351)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgcgccggcacgacttcttcaagtccgccatgcccgaaggctacgtccaggagcgcaccatcttcttcaaggacgacggcaactacaagacccgcgccgaggtgaagttcgagggc

SEQ ID NO: 403 - protein, 117 aa, Artificial
  modif. frag.;  BFP F1C w. F64L, Y66H mutations
MVSKGEELFTGVVPILVELDGDVNGHKFSVSGEGEGDATYGKLTLKFICTTGKLPVPWPTLVTTLGHGLQCFARYPDHMRRHDFFKSAMPEGYVQERTIFFKDDGNYKTRAEVKFEG

SEQ ID NO: 404 - DNA, 348 bp, Artificial
  modif. frag.;  BFP F1C w. F64L, Y66H mutations & posit. 1 Met removed
  CDS (1)..(348)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgcgccggcacgacttcttcaagtccgccatgcccgaaggctacgtccaggagcgcaccatcttcttcaaggacgacggcaactacaagacccgcgccgaggtgaagttcgagggc

SEQ ID NO: 405 - protein, 116 aa, Artificial
  modif. frag.;  BFP F1C w. F64L, Y66H mutations & posit. 1 Met removed
VSKGEELFTGVVPILVELDGDVNGHKFSVSGEGEGDATYGKLTLKFICTTGKLPVPWPTLVTTLGHGLQCFARYPDHMRRHDFFKSAMPEGYVQERTIFFKDDGNYKTRAEVKFEG

SEQ ID NO: 406 - DNA, 369 bp, Artificial
  modif. frag.; YFP F2C and Met added @ position 1
  CDS (1)..(369): YFP F2C corresponds to aa residues 118-239 of YFP
atggacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 407 - protein, 123 aa, Artificial
  modif. frag.; YFP F2C and Met added @ position 1
MDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 408 - DNA, 366 bp, Artificial
  modif. frag.; YFP F2C with Y203F mutation
  CDS (1)..(366)
gacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 409 - protein, 122 aa, Artificial
  modif. frag.; YFP F2C with Y203F mutation
DTLVNRIELKGIDFKEDGNILGHKLEYNYNSHNVYIMADKQKNGIKVNFKIRHNIEDGSVQLADHYQQNTPIGDGPVLLPDNHYLSFQSALSKDPNEKRDHMVLLEFVTAAGITLGMDELYK

SEQ ID NO: 410 - DNA, 369 bp, Artificial
  modif. frag.; YFP F2C w. Y203F mutation and Met added @ posit. 1
  CDS (1)..(369)
atggacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 411 - protein, 123 aa, Artificial
  modif. frag.; YFP F2C w. Y203F mutation and Met added @ posit. 1
MDTLVNRIELKGIDFKEDGNILGHKLEYNYNSHNVYIMADKQKNGIKVNFKIRHNIEDGSVQLADHYQQNTPIGDGPVLLPDNHYLSFQSALSKDPNEKRDHMVLLEFVTAAGITLGMDELYK

SEQ ID NO: 412 - DNA, 366 bp, Artificial
  modif. frag.; YFP F2C with Y203H mutation
  CDS (1)..(366)
gacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 413 - protein, 122 aa, Artificial
  modif. frag.; YFP F2C with Y203H mutation
DTLVNRIELKGIDFKEDGNILGHKLEYNYNSHNVYIMADKQKNGIKVNFKIRHNIEDGSVQLADHYQQNTPIGDGPVLLPDNHYLSHQSALSKDPNEKRDHMVLLEFVTAAGITLGMDELYK

SEQ ID NO: 414 - DNA, 369 bp, Artificial
  modif. frag.; YFP F2C w. Y203H mutation and Met added @ posit. 1
  CDS (1)..(369)
atggacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 415 - protein, 123 aa, Artificial
  modif. frag.; YFP F2C w. Y203H mutation and Met added @ posit. 1
MDTLVNRIELKGIDFKEDGNILGHKLEYNYNSHNVYIMADKQKNGIKVNFKIRHNIEDGSVQLADHYQQNTPIGDGPVLLPDNHYLSHQSALSKDPNEKRDHMVLLEFVTAAGITLGMDELYK

SEQ ID NO: 416 - DNA, 366 bp, Artificial
  modif. frag.; CFP F2C with N146I  mutation
  CDS (1)..(366): CFP F2C  corresponds to residues 118-239 of YFP
gacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 417 - protein, 122 aa, Artificial
  modif. frag.; CFP F2C with N146I  mutation
DTLVNRIELKGIDFKEDGNILGHKLEYNYISHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 418 - DNA, 369 bp, Artificial
  modif. frag.; CFP F2C w. N146I mutation and Met added @ posit. 1
  CDS (1)..(369)
atggacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 419 - protein, 123 aa, Artificial
  modif. frag.; CFP F2C w. N146I mutation and Met added @ posit. 1
MDTLVNRIELKGIDFKEDGNILGHKLEYNYISHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 420 - DNA, 366 bp, Artificial
  modif. frag.; CFP F2C  with M153T  mutation
  CDS (1)..(366)
gacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 421 - protein, 122 aa, Artificial
  modif. frag.; CFP F2C  with M153T  mutation
DTLVNRIELKGIDFKEDGNILGHKLEYNYNSHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 422 - DNA, 369 bp, Artificial
  modif. frag.; CFP F2C  w. M153T mutation + Met @ posit. 1
  CDS (1)..(369)
atggacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 423 - protein, 123 aa, Artificial
  modif. frag.; CFP F2C w. M153T mutation and Met added @ posit. 1
MDTLVNRIELKGIDFKEDGNILGHKLEYNYNSHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 424 - DNA, 366 bp, Artificial
  modif. frag.; CFP F2C w. N146I,  M153T  mutations
  CDS (1)..(366)
gacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 425 - protein, 122 aa, Artificial
  modif. frag.; CFP F2C w. N146I,  M153T  mutations
DTLVNRIELKGIDFKEDGNILGHKLEYNYISHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 426 - DNA, 369 bp, Artificial
  modif. frag.; CFP F2C w. N146I, M153T mutations and Met added @ posit. 1
  CDS (1)..(369)
atggacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 427 - protein, 123 aa, Artificial
  modif. frag.; CFP F2C  w. N146I, M153T mutations and Met added @ posit. 1
MDTLVNRIELKGIDFKEDGNILGHKLEYNYISHNVYITADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 428 - DNA, 366 bp, Artificial
  modif. frag.; CFP F2C with V163A  mutation
  CDS (1)..(366)
gacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 429 - protein, 122 aa, Artificial
  modif. frag.; CFP F2C with V163A  mutation
DTLVNRIELKGIDFKEDGNILGHKLEYNYNSHNVYIMADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 430 - DNA, 369 bp, Artificial
  modif. frag.; CFP F2C w. V163A  mutation and Met added @ posit. 1
  CDS (1)..(369)
atggacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 431 - protein, 123 aa, Artificial
  modif. frag.; CFP F2C w. V163A  mutation and Met added @ posit. 1
MDTLVNRIELKGIDFKEDGNILGHKLEYNYNSHNVYIMADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 432 - DNA, 366 bp, Artificial
  modif. frag.; CFP F2C  w. N146I, V163A  mutations
  CDS (1)..(366)
gacaccctggtgaaccgcatcgagctgaagggcatcgacttcaaggaggacggcaacatcctggggcacaagctggagtacaactacatcagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 433 - protein, 122 aa, Artificial
  modif. frag.; CFP F2C  w. N146I, V163A  mutations
DTLVNRIELKGIDFKEDGNILGHKLEYNYISHNVYIMADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 434 - DNA, 369 bp, Artificial
  modif. frag.; CFP F2C w. N146I, V163A  mutations and Met added @ posit. 1
  CDS (1)..(369)
atggacaccctggtgaaccgcatcgagctgaagggcatcgacttcaaggaggacggcaacatcctggggcacaagctggagtacaactacatcagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 435 - protein, 123 aa, Artificial
  modif. frag.; CFP F2C w. N146I, V163A  mutations and Met added @ posit. 1
MDTLVNRIELKGIDFKEDGNILGHKLEYNYISHNVYIMADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 436 - DNA, 366 bp, Artificial
  modif. frag.; CFP F2C w. M153T, V163A  mutations
  CDS (1)..(366)
gacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 437 - protein, 122 aa, Artificial
  modif. frag.; CFP F2C w. M153T, V163A  mutations
DTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 438 - DNA, 369 bp, Artificial
  modif. frag.; CFP F2C w. M153T, V163A mutations and Met added @ posit. 1
  CDS (1)..(369)
atggacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 439 - protein, 123 aa, Artificial
  modif. frag.; CFP F2C w. M153T, V163A mutations and Met added @ posit. 1
MDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 440 - DNA, 366 bp, Artificial
  modif. frag.; CFP F2C, N146I, M153T, and V163A mutations
  CDS (1)..(366)
gacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 441 - protein, 122 aa, Artificial
  modif. frag.; CFP F2C, N146I, M153T, and V163A mutations
DTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 442 - DNA, 369 bp, Artificial
  modif. frag.; CFP F2C, N146I, M153T, and V163A mutations and Met added @ posit. 1
  CDS (1)..(369)
atggacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 443 - protein, 123 aa, Artificial
  modif. frag.; CFP F2C, N146I, M153T, and V163A mutations and Met added @ posit. 1
MDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 444 - DNA, 366 bp, Artificial
  modif. frag.; CGFP F2C w. M153T, T203Y mutations
  CDS (1)..(366): CGFP F2C corresponds to residues 118-239 of YFP
gacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 445 - protein, 122 aa, Artificial
  modif. frag.; CGFP F2C w. M153T, T203Y mutations
DTLVNRIELKGIDFKEDGNILGHKLEYNYNSHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 446 - DNA, 369 bp, Artificial
  modif. frag.; CGFP F2C w. M153T, T203Y mutations and Met added @ posit. 1
  CDS (1)..(369)
atggacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 447 - protein, 123 aa, Artificial
  modif. frag.; CGFP F2C w. M153T, T203Y mutations and Met added @ posit. 1
MDTLVNRIELKGIDFKEDGNILGHKLEYNYNSHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 448 - DNA, 366 bp, Artificial
  modif. frag.; CGFP F2C w. V163A, T203Y mutations
  CDS (1)..(366)
gacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 449 - protein, 122 aa, Artificial
  modif. frag.; CGFP F2C w. V163A, T203Y mutations
DTLVNRIELKGIDFKEDGNILGHKLEYNYNSHNVYIMADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 450 - DNA, 369 bp, Artificial
  modif. frag.; CGFP F2C w. V163A, T203Y mutations and Met added @ posit. 1
  CDS (1)..(369)
atggacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 451 - protein, 123 aa, Artificial
  modif. frag.; CGFP F2C w. V163A, T203Y mutations and Met added @ posit. 1
MDTLVNRIELKGIDFKEDGNILGHKLEYNYNSHNVYIMADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 452 - DNA, 366 bp, Artificial
  modif. frag.; CGFP F2C, N146I, M153T, and T203Y mutations
  CDS (1)..(366)
gacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 453 - protein, 122 aa, Artificial
  modif. frag.; CGFP F2C, N146I, M153T, and T203Y mutations
DTLVNRIELKGIDFKEDGNILGHKLEYNYISHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 454 - DNA, 369 bp, Artificial
  modif. frag.; CGFP F2C, N146I, M153T, and T203Y mutations and Met added @ posit. 1
  CDS (1)..(369)
atggacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 455 - protein, 123 aa, Artificial
  modif. frag.; CGFP F2C, N146I, M153T, and T203Y mutations and Met added @ posit. 1
MDTLVNRIELKGIDFKEDGNILGHKLEYNYISHNVYITADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 456 - DNA, 366 bp, Artificial
  modif. frag.; CGFP F2C, M153T, V163A, and T203Y mutations
  CDS (1)..(366)
gacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 457 - protein, 122 aa, Artificial
  modif. frag.; CGFP F2C, M153T, V163A, and T203Y mutations
DTLVNRIELKGIDFKEDGNILGHKLEYNYNSHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 458 - DNA, 369 bp, Artificial
  modif. frag.; CGFP F2C, M153T, V163A, and T203Y mutations and Met added @ posit. 1
  CDS (1)..(369)
atggacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 459 - protein, 123 aa, Artificial
  modif. frag.; CGFP F2C, M153T, V163A, and T203Y mutations and Met added @ posit. 1
MDTLVNRIELKGIDFKEDGNILGHKLEYNYNSHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 460 - DNA, 366 bp, Artificial
  modif. frag.; CGFP F2C, N146I, M153T, V163A, and T203Y mutations
  CDS (1)..(366)
gacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 461 - protein, 122 aa, Artificial
  modif. frag.; CGFP F2C, N146I, M153T, V163A, and T203Y mutations
DTLVNRIELKGIDFKEDGNILGHKLEYNYISHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 462 - DNA, 369 bp, Artificial
  modif. frag.; CGFP F2C, N146I, M153T, V163A, and T203Y mutations and Met added @ posit. 1
  CDS (1)..(369)
atggacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 463 - protein, 123 aa, Artificial
  modif. frag.; CGFP F2C, N146I, M153T, V163A, and T203Y mutations and Met added @ posit. 1
MDTLVNRIELKGIDFKEDGNILGHKLEYNYISHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 464 - DNA, 366 bp, Artificial
  modif. frag.; BFP F2C w. Y145F mutation
  CDS (1)..(366): BFP F2C corresponds to aa residues 118-239 of YFP
gacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 465 - protein, 122 aa, Artificial
  modif. frag.; BFP F2C w. Y145F mutation
DTLVNRIELKGIDFKEDGNILGHKLEYNFNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 466 - DNA, 369 bp, Artificial
  modif. frag.; BFP F2C w. Y145F mutation and Met added @ posit. 1
  CDS (1)..(369)
atggacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 467 - protein, 123 aa, Artificial
  modif. frag.; BFP F2C w. Y145F mutation and Met added @ posit. 1
MDTLVNRIELKGIDFKEDGNILGHKLEYNFNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 468 - DNA, 366 bp, Artificial
  modif. frag.; Venus F2C with S175G mutation
  CDS (1)..(366): Venus F2C corresponds to aa residues 118-239 of YFP
gacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 469 - protein, 122 aa, Artificial
  modif. frag.; Venus F2C with S175G mutation
DTLVNRIELKGIDFKEDGNILGHKLEYNYNSHNVYIMADKQKNGIKVNFKIRHNIEDGGVQLADHYQQNTPIGDGPVLLPDNHYLSYQSALSKDPNEKRDHMVLLEFVTAAGITLGMDELYK

SEQ ID NO: 470 - DNA, 369 bp, Artificial
  modif. frag.; Venus F2C w. S175G mutation + Met @ posit. 1
  CDS (1)..(369)
atggacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 471 - protein, 123 aa, Artificial
  modif. frag.; Venus F2C w. S175G mutation + Met @ posit. 1
MDTLVNRIELKGIDFKEDGNILGHKLEYNYNSHNVYIMADKQKNGIKVNFKIRHNIEDGGVQLADHYQQNTPIGDGPVLLPDNHYLSYQSALSKDPNEKRDHMVLLEFVTAAGITLGMDELYK

SEQ ID NO: 472 - DNA, 366 bp, Artificial
  modif. frag.; Venus F2C w. M153T, S175G mutations
  CDS (1)..(366)
gacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 473 - protein, 122 aa, Artificial
  modif. frag.; Venus F2C w. M153T, S175G mutations
DTLVNRIELKGIDFKEDGNILGHKLEYNYNSHNVYITADKQKNGIKVNFKIRHNIEDGGVQLADHYQQNTPIGDGPVLLPDNHYLSYQSALSKDPNEKRDHMVLLEFVTAAGITLGMDELYK

SEQ ID NO: 474 - DNA, 369 bp, Artificial
  modif. frag.; Venus F2C w. M153T, S175G mutations and Met added @ posit. 1
  CDS (1)..(369)
atggacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 475 - protein, 123 aa, Artificial
  modif. frag.; Venus F2C w. M153T, S175G mutations and Met added @ posit. 1
MDTLVNRIELKGIDFKEDGNILGHKLEYNYNSHNVYITADKQKNGIKVNFKIRHNIEDGGVQLADHYQQNTPIGDGPVLLPDNHYLSYQSALSKDPNEKRDHMVLLEFVTAAGITLGMDELYK

SEQ ID NO: 476 - DNA, 366 bp, Artificial
  modif. frag.; Venus F2C w. V163A, S175G mutations
  CDS (1)..(366)
gacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 477 - protein, 122 aa, Artificial
  modif. frag.; Venus F2C w. V163A, S175G mutations
DTLVNRIELKGIDFKEDGNILGHKLEYNYNSHNVYIMADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 478 - DNA, 369 bp, Artificial
  modif. frag.; Venus F2C w. V163A, S175G mutations and Met added @ posit. 1
  CDS (1)..(369)
atggacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 479 - protein, 123 aa, Artificial
  modif. frag.; Venus F2C w. V163A, S175G mutations and Met added @ posit. 1
MDTLVNRIELKGIDFKEDGNILGHKLEYNYNSHNVYIMADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 480 - DNA, 366 bp, Artificial
  modif. frag.; Venus F2C, M153T, V163A, and S175G mutations
  CDS (1)..(366)
gacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 481 - protein, 122 aa, Artificial
  modif. frag.; Venus F2C, M153T, V163A, and S175G mutations
DTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 482 - DNA, 369 bp, Artificial
  modif. frag.; Venus  F2C, M153T, V163A, and S175G mutations and Met added @ posit. 1
  CDS (1)..(369)
atggacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 483 - protein, 123 aa, Artificial
  modif. frag.; Venus  F2C, M153T, V163A, and S175G mutations and Met added @ posit. 1
MDTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 484 - DNA, 471 bp, Artificial
  modif. frag.; YFP F1DX w. position 1 Met removed
  CDS (1)..(471): YFP F1DX fragment corresponds to aa residues 1-158 of YFP
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 485 - protein, 157 aa, Artificial
  modif. frag.; YFP F1DX w. position 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 486 - DNA, 474 bp, Artificial
  modif. frag.; YFP F1DX with K79R mutation
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 487 - protein, 158 aa, Artificial
  modif. frag.; YFP F1DX with K79R mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 488 - DNA, 471 bp, Artificial; identical to SEQ ID NO: 484
  modif. frag.; YFP F1DX, w. K79R mutation, and posit. 1 Met removed
  CDS (1)..(471)

SEQ ID NO: 489 - protein, 157 aa, Artificial; identical to SEQ ID NO: 485
  modif. frag.; YFP F1DX, w. K79R mutation, and posit. 1 Met removed

SEQ ID NO: 490 - DNA, 474 bp, Artificial
  modif. frag.; YFP F1DX with Y66F mutation
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 491 - protein, 158 aa, Artificial
  modif. frag.; YFP F1DX with Y66F mutation
MVSKGEELFTGVVPILVELDGDVNGHKFSVSGEGEGDATYGKLTLKFICTTGKLPVPWPTLVTTFGFGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 492 - DNA, 471 bp, Artificial
  modif. frag.; YFP F1DX, Y66F mutation, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 493 - protein, 157 aa, Artificial
  modif. frag.; YFP F1DX, Y66F mutation, and posit. 1 Met removed
VSKGEELFTGVVPILVELDGDVNGHKFSVSGEGEGDATYGKLTLKFICTTGKLPVPWPTLVTTFGFGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 494 - DNA, 474 bp, Artificial
  modif. frag.; YFP F1DX with Q69K mutation
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 495 - protein, 158 aa, Artificial
  modif. frag.; YFP F1DX with Q69K mutation
MVSKGEELFTGVVPILVELDGDVNGHKFSVSGEGEGDATYGKLTLKFICTTGKLPVPWPTLVTTFGYGLKCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 496 - DNA, 471 bp, Artificial
  modif. frag.; YFP F1DX, Q69K mutation, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 497 - protein, 157 aa, Artificial
  modif. frag.; YFP F1DX, Q69K mutation, and posit. 1 Met removed
VSKGEELFTGVVPILVELDGDVNGHKFSVSGEGEGDATYGKLTLKFICTTGKLPVPWPTLVTTFGYGLKCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 498 - DNA, 474 bp, Artificial
  modif. frag.; citrine F1DX with V68L, Q69M mutations
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 499 - protein, 158 aa, Artificial
  modif. frag.; citrine F1DX with V68L, Q69M mutations
MVSKGEELFTGVVPILVELDGDVNGHKFSVSGEGEGDATYGKLTLKFICTTGKLPVPWPTLVTTFGYGLMCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 500 - DNA, 471 bp, Artificial
  modif. frag.; citrine  F1DX, V68L and Q69M mutations, and position 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 501 - protein, 157 aa, Artificial
  modif. frag.; citrine  F1DX, V68L and Q69M mutations, and position 1 Met removed
VSKGEELFTGVVPILVELDGDVNGHKFSVSGEGEGDATYGKLTLKFICTTGKLPVPWPTLVTTFGYGLMCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 502 - DNA, 474 bp, Artificial
  modif. frag.; CFP F1DX  with F64L mutation
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 503 - protein, 158 aa, Artificial
  modif. frag.; CFP F1DX  with F64L mutation
MVSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 504 - DNA, 471 bp, Artificial
  modif. frag.; CFP F1DX w. F64L mutation, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 505 - protein, 157 aa, Artificial
  modif. frag.; CFP F1DX w. F64L mutation, and posit. 1 Met removed
VSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 506 - DNA, 474 bp, Artificial
  modif. frag.; CFP F1DX, F64L, S65T, and Y66W mutations
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 507 - protein, 158 aa, Artificial
  modif. frag.; CFP F1DX, F64L, S65T, and Y66W mutations
MVSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 508 - DNA, 471 bp, Artificial
  modif. frag.; CFP F1DX, F64L, S65T, and Y66W mutations, and position 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 509 - protein, 157 aa, Artificial
  modif. frag.; CFP F1DX, F64L, S65T, and Y66W mutations, and position 1 Met removed
VSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 510 - DNA, 474 bp, Artificial
  modif. frag.; CFP F1DX with Y66W mutation
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 511 - protein, 158 aa, Artificial
  modif. frag.; CFP F1DX with Y66W mutation
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 512 - DNA, 471 bp, Artificial
  modif. frag.; CFP F1DX w. Y66W mutation, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 513 - protein, 157 aa, Artificial
  modif. frag.; CFP F1DX w. Y66W mutation, and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 514 - DNA, 474 bp, Artificial
  modif. frag.; CFP F1DX w. Y66W, N146I mutations
  CDS (1)..(471)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcag

SEQ ID NO: 515 - protein, 157 aa, Artificial
  modif. frag.; CFP F1DX w. Y66W, N146I mutations
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYIMADK

SEQ ID NO: 516 - DNA, 471 bp, Artificial
  modif. frag.; CFP F1DX w. Y66W, N146I mutations, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcag

SEQ ID NO: 517 - protein, 157 aa, Artificial
  modif. frag.; CFP F1DX w. Y66W, N146I mutations, and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYIMADKQ

SEQ ID NO: 518 - DNA, 474 bp, Artificial
  modif. frag.; CFP F1DX w. Y66W, M153T mutations
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcag

SEQ ID NO: 519 - protein, 158 aa, Artificial
  modif. frag.; CFP F1DX w. Y66W, M153T mutations
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYITADKQ

SEQ ID NO: 520 - DNA, 471 bp, Artificial
  modif. frag.; CFP F1DX w. Y66W, M153T mutations, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcag

SEQ ID NO: 521 - protein, 157 aa, Artificial
  modif. frag.; CFP F1DX w. Y66W, M153T mutations, and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYITADKQ

SEQ ID NO: 522 - DNA, 474 bp, Artificial
  modif. frag.; CFP F1DX with N146I mutation
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcag

SEQ ID NO: 523 - protein, 158 aa, Artificial
  modif. frag.; CFP F1DX with N146I mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYIMADKQ

SEQ ID NO: 524 - DNA, 471 bp, Artificial
  modif. frag.; CFP F1DX w. N146I mutation, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcag

SEQ ID NO: 525 - protein, 157 aa, Artificial
  modif. frag.; CFP F1DX w. N146I mutation, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYIMADKQ

SEQ ID NO: 526 - DNA, 474 bp, Artificial
  modif. frag.; CFP F1DX with M153T mutation
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcag

SEQ ID NO: 527 - protein, 158 aa, Artificial
  modif. frag.; CFP F1DX with M153T mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQ

SEQ ID NO: 528 - DNA, 471 bp, Artificial
  modif. frag.; CFP F1DX w. M153T mutation, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcag

SEQ ID NO: 529 - protein, 157 aa, Artificial
  modif. frag.; CFP F1DX w. M153T mutation, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQ

SEQ ID NO: 530 - DNA, 474 bp, Artificial
  modif. frag.; CFP F1DX w. N146I,  M153T mutations
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcag

SEQ ID NO: 531 - protein, 158 aa, Artificial
  modif. frag.; CFP F1DX w. N146I,  M153T mutations
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQ

SEQ ID NO: 532 - DNA, 471 bp, Artificial
  modif. frag.; CFP F1DX, N146I, M153T mutations, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcag

SEQ ID NO: 533 - protein, 157 aa, Artificial
  modif. frag.; CFP F1DX, N146I, M153T mutations, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQ

SEQ ID NO: 534 - DNA, 474 bp, Artificial
  modif. frag.; CFP F1DX, Y66W, N146I, and M153T mutations
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcag

SEQ ID NO: 535 - protein, 158 aa, Artificial
  modif. frag.; CFP F1DX, Y66W, N146I, and M153T mutations
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYITADKQ

SEQ ID NO: 536 - DNA, 471 bp, Artificial
  modif. frag.; CFP F1DX, Y66W, N146I, and M153T mutations, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcag

SEQ ID NO: 537 - protein, 157 aa, Artificial
  modif. frag.; CFP F1DX, Y66W, N146I, and M153T mutations, and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYITADKQ

SEQ ID NO: 538 - DNA, 474 bp, Artificial
  modif. frag.; CFP F1DX, with S65A mutation
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 539 - protein, 158 aa, Artificial
  modif. frag.; CFP F1DX, with S65A mutation
MVSKGEELFTGVVPILVELDGDVNGHKFSVSGEGEGDATYGKLTLKFICTTGKLPVPWPTLVTTFAYGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 540 - DNA, 471 bp, Artificial
  modif. frag.; CFP F1DX, w. S65A mutation, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 541 - protein, 157 aa, Artificial
  modif. frag.; CFP F1DX, w. S65A mutation, and posit. 1 Met removed
VSKGEELFTGVVPILVELDGDVNGHKFSVSGEGEGDATYGKLTLKFICTTGKLPVPWPTLVTTFAYGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 542 - DNA, 474 bp, Artificial
  modif. frag.; CFP F1DX, S65A, Y66W, and S72A mutations
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 543 - protein, 158 aa, Artificial
  modif. frag.; CFP F1DX, S65A, Y66W, and S72A mutations
MVSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 544 - DNA, 471 bp, Artificial
  modif. frag.; CFP F1DX, S65A, Y66W, and S72A mutations, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 545 - protein, 157 aa, Artificial
  modif. frag.; CFP F1DX, S65A, Y66W, and S72A mutations, and posit. 1 Met removed
VSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 546 - DNA, 474 bp, Artificial
  modif. frag.; BFP F1DX, with Y66H mutation
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 547 - protein, 158 aa, Artificial
  modif. frag.; BFP F1DX, with Y66H mutation
MVSKGEELFTGVVPILVELDGDVNGHKFSVSGEGEGDATYGKLTLKFICTTGKLPVPWPTLVTTFGHGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 548 - DNA, 471 bp, Artificial
  modif. frag.; BFP F1DX, w. Y66H mutation, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 549 - protein, 157 aa, Artificial
  modif. frag.; BFP F1DX, w. Y66H mutation, and posit. 1 Met removed
VSKGEELFTGVVPILVELDGDVNGHKFSVSGEGEGDATYGKLTLKFICTTGKLPVPWPTLVTTFGHGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 550 - DNA, 474 bp, Artificial
  modif. frag.; BFP F1DX, w. F64L, Y66H mutations
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 551 - protein, 158 aa, Artificial
  modif. frag.; BFP F1DX, w. F64L, Y66H mutations
MVSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 552 - DNA, 471 bp, Artificial
  modif. frag.; BFP F1DX, w. F64L, Y66H mutations, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 553 - protein, 157 aa, Artificial
  modif. frag.; BFP F1DX, w. F64L, Y66H mutations, and posit. 1 Met removed
VSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 554 - DNA, 474 bp, Artificial
  modif. frag.; BFP F1DX, F64L, Y66H, Y145F mutations
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcag

SEQ ID NO: 555 - protein, 158 aa, Artificial
  modif. frag.; BFP F1DX, F64L, Y66H, Y145F mutations
MVSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNFNSHNVYIMADKQ

SEQ ID NO: 556 - DNA, 471 bp, Artificial
  modif. frag.; BFP F1DX, F64L, Y66H, Y145F mutations and posit.1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcag

SEQ ID NO: 557 - protein, 157 aa, Artificial
  modif. frag.; BFP F1DX, F64L, Y66H, Y145F mutations and posit.1 Met removed
VSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNFNSHNVYIMADKQ

SEQ ID NO: 558 - DNA, 474 bp, Artificial
  modif. frag.; BFP F1DX with Y145F mutation
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcag

SEQ ID NO: 559 - protein, 158 aa, Artificial
  modif. frag.; BFP F1DX with Y145F mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNFNSHNVYIMADKQ

SEQ ID NO: 560 - DNA, 471 bp, Artificial
  modif. frag.; BFP F1DX w. Y145F mutation and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcag

SEQ ID NO: 561 - protein, 157 aa, Artificial
  modif. frag.; BFP F1DX w. Y145F mutation and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNFNSHNVYIMADKQ

SEQ ID NO: 562 - DNA, 474 bp, Artificial
  modif. frag.; BFP F1DX, F46L, F64L, and Y145F mutations
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcag

SEQ ID NO: 563 - protein, 158 aa, Artificial
  modif. frag.; BFP F1DX, F46L, F64L, and Y145F mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNFNSHNVYIMADKQ

SEQ ID NO: 564 - DNA, 471 bp, Artificial
  modif. frag.; BFP F1DX, F46L, F64L, and Y145F mutations, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcag

SEQ ID NO: 565 - protein, 157 aa, Artificial
  modif. frag.; BFP F1DX, F46L, F64L, and Y145F mutations, and posit. 1 Met removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNFNSHNVYIMADKQ

SEQ ID NO: 566 - DNA, 474 bp, Artificial
  modif. frag.; Venus F1DX, with F46L mutation
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 567 - protein, 158 aa, Artificial
  modif. frag.; Venus F1DX, with F46L mutation
MVSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 568 - DNA, 471 bp, Artificial
  modif. frag.; Venus F1DX, w. F46L mutation, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 569 - protein, 157 aa, Artificial
  modif. frag.; Venus F1DX, w. F46L mutation, and posit. 1 Met removed
VSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 570 - DNA, 474 bp, Artificial
  modif. frag.; Venus F1DX, w. F46L, F64L mutations
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 571 - protein, 158 aa, Artificial
  modif. frag.; Venus F1DX, w. F46L, F64L mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 572 - DNA, 471 bp, Artificial
  modif. frag.; Venus F1DX, w. F46L, F64L mutations, and posit. 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcag

SEQ ID NO: 573 - protein, 157 aa, Artificial
  modif. frag.; Venus F1DX, w. F46L, F64L mutations, and posit. 1 Met removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQ

SEQ ID NO: 574 - DNA, 474 bp, Artificial
  modif. frag.; SEYFP F1DX, w. F64L, M153T mutations
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcag

SEQ ID NO: 575 - protein, 158 aa, Artificial
  modif. frag.; SEYFP F1DX, w. F64L, M153T mutations
MVSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQ

SEQ ID NO: 576 - DNA, 471 bp, Artificial
  modif. frag.; SEYFP F1DX, F64L, M153T mutations, and position 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcag

SEQ ID NO: 577 - protein, 157 aa, Artificial
  modif. frag.; SEYFP F1DX, F64L, M153T mutations, and position 1 Met removed
VSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQ

SEQ ID NO: 578 - DNA, 474 bp, Artificial; identical to SEQ ID NO: 574
  modif. frag.; Venus F1DX, w. F64L, M153T mutations
  CDS (1)..(474)

SEQ ID NO: 579 - protein, 158 aa, Artificial; identical to SEQ ID NO: 575
  modif. frag.; Venus F1DX, w. F64L, M153T mutations

SEQ ID NO: 580 - DNA, 471 bp, Artificial; identical to SEQ ID NO: 576
  modif. frag.; Venus F1DX, w. F64L, M153T mutations, and posit. 1 Met removed
  CDS (1)..(471)

SEQ ID NO: 581 - protein, 157 aa, Artificial; identical to SEQ ID NO: 577
  modif. frag.; Venus F1DX, w. F64L, M153T mutations, and posit. 1 Met removed

SEQ ID NO: 582 - DNA, 474 bp, Artificial
  modif. frag.; Venus F1DX, F46L, F64L, and M153T mutations
  CDS (1)..(474)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcag

SEQ ID NO: 583 - protein, 158 aa, Artificial
  modif. frag.; Venus F1DX, F46L, F64L, and M153T mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQ

SEQ ID NO: 584 - DNA, 471 bp, Artificial
  modif. frag.; Venus F1DX, F46L, F64L, and M153T mutations, and position 1 Met removed
  CDS (1)..(471)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcag

SEQ ID NO: 585 - protein, 157 aa, Artificial
  modif. frag.; Venus F1DX, F46L, F64L, and M153T mutations, and position 1 Met removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQ

SEQ ID NO: 586 - DNA, 246 bp, Artificial
  modif. frag.; YFPF2DX, with Met added @ posit. 1
  CDS (1)..(246): YFP F2DX corresponds to aa residues 159-239 of YFP
atgaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 587 - protein, 82 aa, Artificial
  modif. frag.; YFPF2DX, with Met added @ posit. 1
MKNGIKVNFKIRHNIEDGSVQLADHYQQNTPIGDGPVLLPDNHYLSYQSALSKDPNEKRDHMVLLEFVTAAGITLGMDELYK

SEQ ID NO: 588 - DNA, 243 bp, Artificial
  modif. frag.; YFPF2DX, with Y203F mutation
  CDS (1)..(243)
aagaacggcatcaaggtgaacttcaagatccgccacaacatcgaggacggcagcgtgcagctcgccgaccactaccagcagaacacccccatcggcgacggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 589 - protein, 81 aa, Artificial
  modif. frag.; YFPF2DX, with Y203F mutation
KNGIKVNFKIRHNIEDGSVQLADHYQQNTPIGDGPVLLPDNHYLSFQSALSKDPNEKRDHMVLLEFVTAAGITLGMDELYK

SEQ ID NO: 590 - DNA, 246 bp, Artificial
  modif. frag.; YFP F2DX, w. Y203F mutation and Met added @ posit. 1
  CDS (1)..(246)
atgaagaacggcatcaaggtgaacttcaagatccgccacaacatcgaggacggcagcgtgcagctcgccgaccactaccagcagaacacccccatcggcgacggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 591 - protein, 82 aa, Artificial
  modif. frag.; YFP F2DX, w. Y203F mutation and Met added @ posit. 1
MKNGIKVNFKIRHNIEDGSVQLADHYQQNTPIGDGPVLLPDNHYLSFQSALSKDPNEKRDHMVLLEFVTAAGITLGMDELYK

SEQ ID NO: 592 - DNA, 243 bp, Artificial
  modif. frag.; YFPF2DX, with Y203H mutation
  CDS (1)..(243)
aagaacggcatcaaggtgaacttcaagatccgccacaacatcgaggacggcagcgtgcagctcgccgaccactaccagcagaacacccccatcggcgacggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 593 - protein, 81 aa, Artificial
  modif. frag.; YFPF2DX, with Y203H mutation
KNGIKVNFKIRHNIEDGSVQLADHYQQNTPIGDGPVLLPDNHYLSHQSALSKDPNEKRDHMVLLEFVTAAGITLGMDELYK

SEQ ID NO: 594 - DNA, 246 bp, Artificial
  modif. frag.;YFP F2DX, w. Y203H mutation and Met added @ posit. 1
  CDS (1)..(246)
atgaagaacggcatcaaggtgaacttcaagatccgccacaacatcgaggacggcagcgtgcagctcgccgaccactaccagcagaacacccccatcggcgacggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 595 - protein, 82 aa, Artificial
  modif. frag.;YFP F2DX, w. Y203H mutation and Met added @ posit. 1
MKNGIKVNFKIRHNIEDGSVQLADHYQQNTPIGDGPVLLPDNHYLSHQSALSKDPNEKRDHMVLLEFVTAAGITLGMDELYK

SEQ ID NO: 596 - DNA, 243 bp, Artificial
  modif. frag.; CFP F2DX, with Y203T mutation
  CDS (1)..(243)
aagaacggcatcaaggtgaacttcaagatccgccacaacatcgaggacggcagcgtgcagctcgccgaccactaccagcagaacacccccatcggcgacggccccgtgctgctgcccgacaaccactacctgagcactcagtccgccctgagcaaagaccccaacgagaagcgcgatcacatggtcctgctggagttcgtgaccgccgccgggatcactctcggcatggacgagctgtacaag

SEQ ID NO: 597 - protein, 81 aa, Artificial
  modif. frag.; CFP F2DX, with Y203T mutation
KNGIKVNFKIRHNIEDGSVQLADHYQQNTPIGDGPVLLPDNHYLSTQSALSKDPNEKRDHMVLLEFVTAAGITLGMDELYK

SEQ ID NO: 598 - DNA, 246 bp, Artificial
  modif. frag.; CFP F2DX, w. Y203T mutation and Met added @ posit. 1
  CDS (1)..(246)
atgaagaacggcatcaaggtgaacttcaagatccgccacaacatcgaggacggcagcgtgcagctcgccgaccactaccagcagaacacccccatcggcgacggccccgtgctgctgcccgacaaccactacctgagcactcagtccgccctgagcaaagaccccaacgagaagcgcgatcacatggtcctgctggagttcgtgaccgccgccgggatcactctcggcatggacgagctgtacaag

SEQ ID NO: 599 - protein, 82 aa, Artificial
  modif. frag.; CFP F2DX, w. Y203T mutation and Met added @ posit. 1
MKNGIKVNFKIRHNIEDGSVQLADHYQQNTPIGDGPVLLPDNHYLSTQSALSKDPNEKRDHMVLLEFVTAAGITLGMDELYK

SEQ ID NO: 600 - DNA, 243 bp, Artificial
  modif. frag.; CFP F2DX, w. V163A, Y203T mutations
  CDS (1)..(243)
aagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 601 - protein, 81 aa, Artificial
  modif. frag.; CFP F2DX, w. V163A, Y203T mutations
KNGIKANFKIRHNIEDGSVQLADHYQQNTPIGDGPVLLPDNHYLSTQSALSKDPNEKRDHMVLLEFVTAAGITLGMDELYK

SEQ ID NO: 602 - DNA, 246 bp, Artificial
  modif. frag.; CFP F2DX, w. V163A, Y203T mutations and Met added @ posit. 1
  CDS (1)..(246)
atgaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 603 - protein, 82 aa, Artificial
  modif. frag.; CFP F2DX, w. V163A, Y203T mutations and Met added @ posit. 1
MKNGIKANFKIRHNIEDGSVQLADHYQQNTPIGDGPVLLPDNHYLSTQSALSKDPNEKRDHMVLLEFVTAAGITLGMDELYK

SEQ ID NO: 604 - DNA, 246 bp, Artificial
  modif. frag.; Venus F2DX, with S175G  mutation
  CDS (1)..(246)
atgaagaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 605 - protein, 82 aa, Artificial
  modif. frag.; Venus F2DX, with S175G  mutation
MKNGIKVNFKIRHNIEDGGVQLADHYQQNTPIGDGPVLLPDNHYLSYQSALSKDPNEKRDHMVLLEFVTAAGITLGMDELYK

SEQ ID NO: 606 - DNA, 246 bp, Artificial; identical to SEQ ID NO: 604
  modif. frag.; Venus F2DX, w. S175G  mutation and Met added @ posit. 1
  CDS (1)..(246)

SEQ ID NO: 607 - protein, 82 aa, Artificial; identical to SEQ ID NO: 605
  modif. frag.; Venus F2DX, w. S175G  mutation and Met added @ posit. 1

SEQ ID NO: 608 - DNA, 243 bp, Artificial
  modif. frag.; Venus F2DX, w. V163A, S175G  mutations
  CDS (1)..(243)
aagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 609 - protein, 81 aa, Artificial
  modif. frag.; Venus F2DX, w. V163A, S175G  mutations
KNGIKANFKIRHNIEDGGVQLADHYQQNTPIGDGPVLLPDNHYLSYQSALSKDPNEKRDHMVLLEFVTAAGITLGMDELYK

SEQ ID NO: 610 - DNA, 246 bp, Artificial
  modif. frag.; Venus F2DX, w. V163A, S175G mutations and Met added @ posit. 1
  CDS (1)..(246)
atgaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 611 - protein, 82 aa, Artificial
  modif. frag.; Venus F2DX, w. V163A, S175G mutations and Met added @ posit. 1
MKNGIKANFKIRHNIEDGGVQLADHYQQNTPIGDGPVLLPDNHYLSYQSALSKDPNEKRDHMVLLEFVTAAGITLGMDELYK

SEQ ID NO: 612 - DNA, 474 bp, Artificial
  modif. frag.; YFP F1D with position 1 Met removed
  CDS (1)..(474): YFP F1D corresponds to aa residues 1-159 of YFP
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 613 - protein, 158 aa, Artificial
  modif. frag.; YFP F1D with position 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 614 - DNA, 477 bp, Artificial
  modif. frag.; YFP F1D  with K79R mutation
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 615 - protein, 159 aa, Artificial
  modif. frag.; YFP F1D  with K79R mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 616 - DNA, 474 bp, Artificial; identical to SEQ ID NO: 612
  modif. frag.; YFP F1D w. K79R mutation, Met @ posit. 1 removed
  CDS (1)..(474)

SEQ ID NO: 617 - protein, 158 aa, Artificial; identical to SEQ ID NO: 613
  modif. frag.; YFP F1D w. K79R mutation, Met @ posit. 1 removed

SEQ ID NO: 618 - DNA, 477 bp, Artificial
  modif. frag.; YFP F1D  with Y66F mutation
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 619 - protein, 159 aa, Artificial
  modif. frag.; YFP F1D  with Y66F mutation
MVSKGEELFTGVVPILVELDGDVNGHKFSVSGEGEGDATYGKLTLKFICTTGKLPVPWPTLVTTFGFGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 620 - DNA, 474 bp, Artificial
  modif. frag.; YFP F1D w. Y66F mutation, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 621 - protein, 158 aa, Artificial
  modif. frag.; YFP F1D w. Y66F mutation, Met @ posit. 1 removed
VSKGEELFTGVVPILVELDGDVNGHKFSVSGEGEGDATYGKLTLKFICTTGKLPVPWPTLVTTFGFGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 622 - DNA, 477 bp, Artificial
  modif. frag.; YFP F1D  with Q69K mutation
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 623 - protein, 159 aa, Artificial
  modif. frag.; YFP F1D  with Q69K mutation
MVSKGEELFTGVVPILVELDGDVNGHKFSVSGEGEGDATYGKLTLKFICTTGKLPVPWPTLVTTFGYGLKCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 624 - DNA, 474 bp, Artificial
  modif. frag.; YFP F1D w. Q69K mutation, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 625 - protein, 158 aa, Artificial
  modif. frag.; YFP F1D w. Q69K mutation, Met @ posit. 1 removed
VSKGEELFTGVVPILVELDGDVNGHKFSVSGEGEGDATYGKLTLKFICTTGKLPVPWPTLVTTFGYGLKCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 626 - DNA, 477 bp, Artificial
  modif. frag.; citrine F1D w. V68L, Q69M mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 627 - protein, 159 aa, Artificial
  modif. frag.; citrine F1D w. V68L, Q69M mutations
MVSKGEELFTGVVPILVELDGDVNGHKFSVSGEGEGDATYGKLTLKFICTTGKLPVPWPTLVTTFGYGLMCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 628 - DNA, 474 bp, Artificial
  modif. frag.; citrine F1D w. V68L, Q69M mutations, Met @ posit.1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 629 - protein, 158 aa, Artificial
  modif. frag.; citrine F1D w. V68L, Q69M mutations, Met @ posit.1 removed
VSKGEELFTGVVPILVELDGDVNGHKFSVSGEGEGDATYGKLTLKFICTTGKLPVPWPTLVTTFGYGLMCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 630 - DNA, 477 bp, Artificial
  modif. frag.; CFP F1D  with F64L mutation
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 631 - protein, 159 aa, Artificial
  modif. frag.; CFP F1D  with F64L mutation
MVSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 632 - DNA, 474 bp, Artificial
  modif. frag.; CFP F1D with F64L mutation, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 633 - protein, 158 aa, Artificial
  modif. frag.; CFP F1D with F64L mutation, Met @ posit. 1 removed
VSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 634 - DNA, 477 bp, Artificial
  modif. frag.; YFP F1D with F46L mutation
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 635 - protein, 159 aa, Artificial
  modif. frag.; YFP F1D with F46L mutation
MVSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 636 - DNA, 474 bp, Artificial
  modif. frag.; YFP F1D with F46L mutation, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 637 - protein, 158 aa, Artificial
  modif. frag.; YFP F1D with F46L mutation, Met @ posit. 1 removed
VSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 638 - DNA, 477 bp, Artificial
  modif. frag.; YFP F1D  with F46L, F64L mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 639 - protein, 159 aa, Artificial
  modif. frag.; YFP F1D  with F46L, F64L mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 640 - DNA, 474 bp, Artificial
  modif. frag.; YFP F1D w. F46L, F64L mutations, and Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 641 - protein, 158 aa, Artificial
  modif. frag.; YFP F1D w. F46L, F64L mutations, and Met @ posit. 1 removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 642 - DNA, 477 bp, Artificial
  modif. frag.; Venus F1D  with  F64L, M153T mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaag

SEQ ID NO: 643 - protein, 159 aa, Artificial
  modif. frag.; Venus F1D  with  F64L, M153T mutations
MVSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQK

SEQ ID NO: 644 - DNA, 474 bp, Artificial
  modif. frag.; Venus F1D  w. F64L, M153T mutations, and Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaag

SEQ ID NO: 645 - protein, 158 aa, Artificial
  modif. frag.; Venus F1D  w. F64L, M153T mutations, and Met @ posit. 1 removed
VSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQK

SEQ ID NO: 646 - DNA, 477 bp, Artificial
  modif. frag.; Venus F1D  with  F46L, M153T mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaag

SEQ ID NO: 647 - protein, 159 aa, Artificial
  modif. frag.; Venus F1D  with  F46L, M153T mutations
MVSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQK

SEQ ID NO: 648 - DNA, 474 bp, Artificial
  modif. frag.; Venus F1D  w. F46L, M153T mutations, and Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaag

SEQ ID NO: 649 - protein, 158 aa, Artificial
  modif. frag.; Venus F1D  w. F46L, M153T mutations, and Met @ posit. 1 removed
VSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQK

SEQ ID NO: 650 - DNA, 477 bp, Artificial
  modif. frag.; Venus F1D, F46L, F64L, and M153T mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaag

SEQ ID NO: 651 - protein, 159 aa, Artificial
  modif. frag.; Venus F1D, F46L, F64L, and M153T mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQK

SEQ ID NO: 652 - DNA, 474 bp, Artificial
  modif. frag.; Venus F1D, F46L, F64L, and M153T mutations, Met @ position 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaag

SEQ ID NO: 653 - protein, 158 aa, Artificial
  modif. frag.; Venus F1D, F46L, F64L, and M153T mutations, Met @ position 1 removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQK

SEQ ID NO: 654 - DNA, 477 bp, Artificial
  modif. frag.; CFP F1D w. F46L, F64L, N146I mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaag

SEQ ID NO: 655 - protein, 159 aa, Artificial
  modif. frag.; CFP F1D w. F46L, F64L, N146I mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYISHNVYIMADKQK

SEQ ID NO: 656 - DNA, 474 bp, Artificial
  modif. frag.; CFP F1D, w. F46L, F64L, N146I mutations, Met @ position 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaag

SEQ ID NO: 657 - protein, 158 aa, Artificial
  modif. frag.; CFP F1D, w. F46L, F64L, N146I mutations, Met @ position 1 removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYISHNVYIMADKQK

SEQ ID NO: 658 - DNA, 477 bp, Artificial
  modif. frag.; CFP F1D, w. F64L, S65T, and Y66W mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 659 - protein, 159 aa, Artificial
  modif. frag.; CFP F1D, w.  F64L, S65T, and Y66W mutations
MVSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 660 - DNA, 474 bp, Artificial
  modif. frag.; CFP F1D, w. F64L, S65T, and Y66W mutations, and Met @ position 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 661 - protein, 158 aa, Artificial
  modif. frag.; CFP F1D, w. F64L, S65T, and Y66W mutations, and Met @ position 1 removed
VSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 662 - DNA, 477 bp, Artificial
  modif. frag.; CFP F1D with Y66W mutation
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 663 - protein, 159 aa, Artificial
  modif. frag.; CFP F1D with Y66W mutation
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 664 - DNA, 474 bp, Artificial
  modif. frag.; CFP F1D with Y66W mutation, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 665 - protein, 158 aa, Artificial
  modif. frag.; CFP F1D with Y66W mutation, Met @ posit. 1 removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 666 - DNA, 477 bp, Artificial
  modif. frag.; CFP F1D with Y66W, N146I  mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaag

SEQ ID NO: 667 - protein, 159 aa, Artificial
  modif. frag.; CFP F1D with Y66W, N146I  mutations
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYIMADKQK

SEQ ID NO: 668 - DNA, 474 bp, Artificial
  modif. frag.; CFP F1D w. Y66W, N146I mutations, and Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaag

SEQ ID NO: 669 - protein, 158 aa, Artificial
  modif. frag.; CFP F1D w. Y66W, N146I mutations, and Met @ posit. 1 removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYIMADKQK

SEQ ID NO: 670 - DNA, 477 bp, Artificial
  modif. frag.; CFP F1D with Y66W, M153T  mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaag

SEQ ID NO: 671 - protein, 159 aa, Artificial
  modif. frag.; CFP F1D with Y66W, M153T  mutations
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYITADKQK

SEQ ID NO: 672 - DNA, 474 bp, Artificial
  modif. frag.; CFP F1D, w. Y66W and M153T mutations, and Met @ position 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaag

SEQ ID NO: 673 - protein, 158 aa, Artificial
  modif. frag.; CFP F1D, w. Y66W and M153T mutations, and Met @ position 1 removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYITADKQK

SEQ ID NO: 674 - DNA, 477 bp, Artificial
  modif. frag.; CFP F1D with N146I mutation
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaag

SEQ ID NO: 675 - protein, 159 aa, Artificial
  modif. frag.; CFP F1D with N146I mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYIMADKQK

SEQ ID NO: 676 - DNA, 474 bp, Artificial
  modif. frag.; CFP F1D w. N146I mutation, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaag

SEQ ID NO: 677 - protein, 158 aa, Artificial
  modif. frag.; CFP F1D w. N146I mutation, Met @ posit. 1 removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYIMADKQK

SEQ ID NO: 678 - DNA, 477 bp, Artificial
  modif. frag.; CFP F1D with M153T mutation
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaag

SEQ ID NO: 679 - protein, 159 aa, Artificial
  modif. frag.; CFP F1D with M153T mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQK

SEQ ID NO: 680 - DNA, 474 bp, Artificial
  modif. frag.; CFP F1D w. M153T mutation, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaag

SEQ ID NO: 681 - protein, 158 aa, Artificial
  modif. frag.; CFP F1D w. M153T mutation, Met @ posit. 1 removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQK

SEQ ID NO: 682 - DNA, 477 bp, Artificial
  modif. frag.; CFP F1D with N146I, M153T mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaag

SEQ ID NO: 683 - protein, 159 aa, Artificial
  modif. frag.; CFP F1D with N146I, M153T mutations
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQK

SEQ ID NO: 684 - DNA, 474 bp, Artificial
  modif. frag.; CFP F1D w. N146I, M153T mutations, and Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaag

SEQ ID NO: 685 - protein, 158 aa, Artificial
  modif. frag.; CFP F1D w. N146I, M153T mutations, and Met @ posit. 1 removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQK

SEQ ID NO: 686 - DNA, 477 bp, Artificial
  modif. frag.; CFP F1D, w. Y66W, N146I, and M153T mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaag

SEQ ID NO: 687 - protein, 159 aa, Artificial
  modif. frag.; CFP F1D, w. Y66W, N146I, and M153T mutations
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYITADKQK

SEQ ID NO: 688 - DNA, 474 bp, Artificial
  modif. frag.; CFP F1D, Y66W, N146I, and M153T mutations, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaag

SEQ ID NO: 689 - protein, 158 aa, Artificial
  modif. frag.; CFP F1D, Y66W, N146I, and M153T mutations, Met @ posit. 1 removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYITADKQK

SEQ ID NO: 690 - DNA, 477 bp, Artificial
  modif. frag.; CFP F1D with S65A mutation
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 691 - protein, 159 aa, Artificial
  modif. frag.; CFP F1D with S65A mutation
MVSKGEELFTGVVPILVELDGDVNGHKFSVSGEGEGDATYGKLTLKFICTTGKLPVPWPTLVTTFAYGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 692 - DNA, 474 bp, Artificial
  modif. frag.; CFP F1D w. S65A mutation, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 693 - protein, 158 aa, Artificial
  modif. frag.; CFP F1D w. S65A mutation, Met @ posit. 1 removed
VSKGEELFTGVVPILVELDGDVNGHKFSVSGEGEGDATYGKLTLKFICTTGKLPVPWPTLVTTFAYGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 694 - DNA, 477 bp, Artificial
  modif. frag.; CFP F1D, w. S65A, Y66W, and S72A mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 695 - protein, 159 aa, Artificial
  modif. frag.; CFP F1D, w. S65A, Y66W, and S72A mutations
MVSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 696 - DNA, 474 bp, Artificial
  modif. frag.; CFP F1D,S65A, Y66W, and S72A mutations, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 697 - protein, 158 aa, Artificial
  modif. frag.; CFP F1D,S65A, Y66W, and S72A mutations, Met @ posit. 1 removed
VSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 698 - DNA, 477 bp, Artificial
  modif. frag.; BFP F1D with Y66H mutation
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 699 - protein, 159 aa, Artificial
  modif. frag.; BFP F1D with Y66H mutation
MVSKGEELFTGVVPILVELDGDVNGHKFSVSGEGEGDATYGKLTLKFICTTGKLPVPWPTLVTTFGHGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 700 - DNA, 474 bp, Artificial
  modif. frag.; BFP F1D w. Y66H mutation, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 701 - protein, 158 aa, Artificial
  modif. frag.; BFP F1D w. Y66H mutation, Met @ posit. 1 removed
VSKGEELFTGVVPILVELDGDVNGHKFSVSGEGEGDATYGKLTLKFICTTGKLPVPWPTLVTTFGHGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 702 - DNA, 477 bp, Artificial
  modif. frag.; BFP F1D w. F64L, Y66H mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 703 - protein, 159 aa, Artificial
  modif. frag.; BFP F1D w. F64L, Y66H mutations
MVSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 704 - DNA, 474 bp, Artificial
  modif. frag.; BFP F1D w. F64L, Y66H mutations, and Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaag

SEQ ID NO: 705 - protein, 158 aa, Artificial
  modif. frag.; BFP F1D w. F64L, Y66H mutations, and Met @ posit. 1 removed
VSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNYNSHNVYIMADKQK

SEQ ID NO: 706 - DNA, 477 bp, Artificial
  modif. frag.; BFP F1D, w. F64L, Y66H, and Y145F mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaag

SEQ ID NO: 707 - protein, 159 aa, Artificial
  modif. frag.; BFP F1D, w. F64L, Y66H, and Y145F mutations
MVSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNFNSHNVYIMADKQK

SEQ ID NO: 708 - DNA, 474 bp, Artificial
  modif. frag.; BFP F1D, w. F64L, Y66H, and Y145F mutations, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaag

SEQ ID NO: 709 - protein, 158 aa, Artificial
  modif. frag.; BFP F1D, w. F64L, Y66H, and Y145F mutations, Met @ posit. 1 removed
VSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNFNSHNVYIMADKQK

SEQ ID NO: 710 - DNA, 477 bp, Artificial
  modif. frag.; BFP F1D, with Y145F mutation
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaag

SEQ ID NO: 711 - protein, 159 aa, Artificial
  modif. frag.; BFP F1D, with Y145F mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNFNSHNVYIMADKQK

SEQ ID NO: 712 - DNA, 474 bp, Artificial
  modif. frag.; BFP F1D, w. Y145F mutation, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaag

SEQ ID NO: 713 - protein, 158 aa, Artificial
  modif. frag.; BFP F1D, w. Y145F mutation, Met @ posit. 1 removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNFNSHNVYIMADKQK

SEQ ID NO: 714 - DNA, 477 bp, Artificial
  modif. frag.; BFP F1D, w. F46L, F64L, and Y145F mutations
  CDS (1)..(477)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaag

SEQ ID NO: 715 - protein, 159 aa, Artificial
  modif. frag.; BFP F1D, w. F46L, F64L, and Y145F mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNFNSHNVYIMADKQK

SEQ ID NO: 716 - DNA, 474 bp, Artificial
  modif. frag.; BFP F1D, w. F46L, F64L, and Y145F mutations, Met @ posit. 1 removed
  CDS (1)..(474)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaag

SEQ ID NO: 717 - protein, 158 aa, Artificial
  modif. frag.; BFP F1D, w. F46L, F64L, and Y145F mutations, Met @ posit. 1 removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNFNSHNVYIMADKQK

SEQ ID NO: 718 - DNA, 243 bp, Artificial
  modif. frag.; YFP F2D, w. Met added @ posit. 1
  CDS (1)..(243): YFP F2D corresponds to aa residues 159-239 of YFP
atgaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 719 - protein, 81 aa, Artificial
  modif. frag.; YFP F2D, w. Met added @ posit. 1
MNGIKVNFKIRHNIEDGSVQLADHYQQNTPIGDGPVLLPDNHYLSYQSALSKDPNEKRDHMVLLEFVTAAGITLGMDELYK

SEQ ID NO: 720 - DNA, 240 bp, Artificial
  modif. frag.; YFP F2D, with Y203F mutation
  CDS (1)..(240)
aacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 721 - protein, 80 aa, Artificial
  modif. frag.; YFP F2D, with Y203F mutation
NGIKVNFKIRHNIEDGSVQLADHYQQNTPIGDGPVLLPDNHYLSYQSALSKDPNEKRDHMVLLEFVTAAGITLGMDELYK

SEQ ID NO: 722 - DNA, 243 bp, Artificial; identical to SEQ ID NO: 718
  modif. frag.; YFP F2D, w. Y203F mutation, Met added @ posit. 1
  CDS (1)..(243)

SEQ ID NO: 723 - protein, 81 aa, Artificial; identical to SEQ ID NO: 719
  modif. frag.; YFP F2D, w. Y203F mutation, Met added @ posit. 1

SEQ ID NO: 724 - DNA, 240 bp, Artificial
  modif. frag.; YFP F2D, with Y203H mutation
  CDS (1)..(240)
aacggcatcaaggtgaacttcaagatccgccacaacatcgaggacggcagcgtgcagctcgccgaccactaccagcagaacacccccatcggcgacggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 725 - protein, 80 aa, Artificial
  modif. frag.; YFP F2D, with Y203H mutation
NGIKVNFKIRHNIEDGSVQLADHYQQNTPIGDGPVLLPDNHYLSHQSALSKDPNEKRDHMVLLEFVTAAGITLGMDELYK

SEQ ID NO: 726 - DNA, 243 bp, Artificial
  modif. frag.; YFP F2D, w. Y203H mutation, Met added @ posit. 1
  CDS (1)..(243)
atgaacggcatcaaggtgaacttcaagatccgccacaacatcgaggacggcagcgtgcagctcgccgaccactaccagcagaacacccccatcggcgacggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 727 - protein, 81 aa, Artificial
  modif. frag.; YFP F2D, w. Y203H mutation, Met added @ posit. 1
MNGIKVNFKIRHNIEDGSVQLADHYQQNTPIGDGPVLLPDNHYLSHQSALSKDPNEKRDHMVLLEFVTAAGITLGMDELYK

SEQ ID NO: 728 - DNA, 240 bp, Artificial
  modif. frag.; CFP F2D, with Y203T mutation
  CDS (1)..(240)
aacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 729 - protein, 80 aa, Artificial
  modif. frag.; CFP F2D, with Y203T mutation
NGIKVNFKIRHNIEDGSVQLADHYQQNTPIGDGPVLLPDNHYLSTQSALSKDPNEKRDHMVLLEFVTAAGITLGMDELYK

SEQ ID NO: 730 - DNA, 243 bp, Artificial
  modif. frag.; CFP F2D, w. Y203T mutation, Met added @ posit. 1
  CDS (1)..(243)
atgaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 731 - protein, 81 aa, Artificial
  modif. frag.; CFP F2D, w. Y203T mutation, Met added @ posit. 1
MNGIKVNFKIRHNIEDGSVQLADHYQQNTPIGDGPVLLPDNHYLSTQSALSKDPNEKRDHMVLLEFVTAAGITLGMDELYK

SEQ ID NO: 732 - DNA, 240 bp, Artificial
  modif. frag.; CFP F2D, w. V163A, Y203T mutations
  CDS (1)..(240)
aacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 733 - protein, 80 aa, Artificial
  modif. frag.; CFP F2D, w. V163A, Y203T mutations
NGIKANFKIRHNIEDGSVQLADHYQQNTPIGDGPVLLPDNHYLSTQSALSKDPNEKRDHMVLLEFVTAAGITLGMDELYK

SEQ ID NO: 734 - DNA, 243 bp, Artificial
  modif. frag. CFP F2D, w. V163A, Y203T, Met added @ posit. 1
  CDS (1)..(243)
atgaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 735 - protein, 81 aa, Artificial
  modif. frag. CFP F2D, w. V163A, Y203T, Met added @ posit. 1
MNGIKANFKIRHNIEDGSVQLADHYQQNTPIGDGPVLLPDNHYLSTQSALSKDPNEKRDHMVLLEFVTAAGITLGMDELYK

SEQ ID NO: 736 - DNA, 240 bp, Artificial
  modif. frag.; Venus  F2D, with S175G mutation
  CDS (1)..(240)
aacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 737 - protein, 80 aa, Artificial
  modif. frag.; Venus  F2D, with S175G mutation
NGIKVNFKIRHNIEDGGVQLADHYQQNTPIGDGPVLLPDNHYLSYQSALSKDPNEKRDHMVLLEFVTAAGITLGMDELYK

SEQ ID NO: 738 - DNA, 243 bp, Artificial
  modif. frag.; Venus F2D, w. S175G mutation, and Met added @ posit. 1
  CDS (1)..(243)
atgaacggcatcaaggtgaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 739 - protein, 81 aa, Artificial
  modif. frag.; Venus F2D, w. S175G mutation, and Met added @ posit. 1
MNGIKVNFKIRHNIEDGGVQLADHYQQNTPIGDGPVLLPDNHYLSYQSALSKDPNEKRDHMVLLEFVTAAGITLGMDELYK

SEQ ID NO: 740 - DNA, 240 bp, Artificial
  modif. frag.; Venus  F2D, w. V163A, S175G mutations
  CDS (1)..(240)
aacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 741 - protein, 80 aa, Artificial
  modif. frag.; Venus  F2D, w. V163A, S175G mutations
NGIKANFKIRHNIEDGGVQLADHYQQNTPIGDGPVLLPDNHYLSYQSALSKDPNEKRDHMVLLEFVTAAGITLGMDELYK

SEQ ID NO: 742 - DNA, 243 bp, Artificial
  modif. frag. Venus F2D, w. V163A, S175G, and Met added @ posit. 1
  CDS (1)..(243)
atgaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 743 - protein, 81 aa, Artificial
  modif. frag. Venus F2D, w. V163A, S175G, and Met added @ posit. 1
MNGIKANFKIRHNIEDGGVQLADHYQQNTPIGDGPVLLPDNHYLSYQSALSKDPNEKRDHMVLLEFVTAAGITLGMDELYK

SEQ ID NO: 744 - DNA, 519 bp, Artificial
  modif. frag.; YFP F1E, with position 1 Met removed
  CDS (1)..(519): YFP F1E corresponds to aa residues 1-174 of YFP
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 745 - protein, 173 aa, Artificial
  modif. frag.; YFP F1E, with position 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 746 - DNA, 522 bp, Artificial
  modif. frag.; YFP F1E, with K79R mutation
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgcgccggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 747 - protein, 174 aa, Artificial
  modif. frag.; YFP F1E, with K79R mutation
MVSKGEELFTGVVPILVELDGDVNGHKFSVSGEGEGDATYGKLTLKFICTTGKLPVPWPTLVTTFGYGLQCFARYPDHMRRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 748 - DNA, 519 bp, Artificial
  modif. frag.; YFP F1E, with K79R mutation, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgcgccggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 749 - protein, 173 aa, Artificial
  modif. frag.; YFP F1E, with K79R mutation, and posit. 1 Met removed
VSKGEELFTGVVPILVELDGDVNGHKFSVSGEGEGDATYGKLTLKFICTTGKLPVPWPTLVTTFGYGLQCFARYPDHMRRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 750 - DNA, 522 bp, Artificial
  modif. frag.; YFP F1E, with Y66F mutation
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 751 - protein, 174 aa, Artificial
  modif. frag.; YFP F1E, with Y66F mutation
MVSKGEELFTGVVPILVELDGDVNGHKFSVSGEGEGDATYGKLTLKFICTTGKLPVPWPTLVTTFGFGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 752 - DNA, 519 bp, Artificial
  modif. frag.; YFP F1E, with Y66F mutation, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 753 - protein, 173 aa, Artificial
  modif. frag.; YFP F1E, with Y66F mutation, and posit. 1 Met removed
VSKGEELFTGVVPILVELDGDVNGHKFSVSGEGEGDATYGKLTLKFICTTGKLPVPWPTLVTTFGFGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 754 - DNA, 522 bp, Artificial
  modif. frag.; YFP F1E, with Q69K mutation
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 755 - protein, 174 aa, Artificial
  modif. frag.; YFP F1E, with Q69K mutation
MVSKGEELFTGVVPILVELDGDVNGHKFSVSGEGEGDATYGKLTLKFICTTGKLPVPWPTLVTTFGYGLKCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 756 - DNA, 519 bp, Artificial
  modif. frag.; YFP F1E, with Q69K mutation, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 757 - protein, 173 aa, Artificial
  modif. frag.; YFP F1E, with Q69K mutation, and posit. 1 Met removed
VSKGEELFTGVVPILVELDGDVNGHKFSVSGEGEGDATYGKLTLKFICTTGKLPVPWPTLVTTFGYGLKCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 758 - DNA, 522 bp, Artificial
  modif. frag.; citrine  F1E, w. V68L, Q69M mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 759 - protein, 174 aa, Artificial
  modif. frag.; citrine  F1E, w. V68L, Q69M mutations
MVSKGEELFTGVVPILVELDGDVNGHKFSVSGEGEGDATYGKLTLKFICTTGKLPVPWPTLVTTFGYGLMCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 760 - DNA, 519 bp, Artificial
  modif. frag.; citrine F1E, w. V68L, Q69M mutations, and posit.1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 761 - protein, 173 aa, Artificial
  modif. frag.; citrine F1E, w. V68L, Q69M mutations, and posit.1 Met removed
VSKGEELFTGVVPILVELDGDVNGHKFSVSGEGEGDATYGKLTLKFICTTGKLPVPWPTLVTTFGYGLMCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 762 - DNA, 522 bp, Artificial
  modif. frag.; CFP  F1E, with F64L mutation
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 763 - protein, 174 aa, Artificial
  modif. frag.; CFP  F1E, with F64L mutation
MVSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 764 - DNA, 519 bp, Artificial
  modif. frag.; CFP  F1E, w. F64L mutation, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 765 - protein, 173 aa, Artificial
  modif. frag.; CFP  F1E, w. F64L mutation, and posit. 1 Met removed
VSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 766 - DNA, 522 bp, Artificial
  modif. frag.; CFP  F1E, w. F64L, S65T, and Y66W mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 767 - protein, 174 aa, Artificial
  modif. frag.; CFP  F1E, w. F64L, S65T, and Y66W mutations
MVSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 768 - DNA, 519 bp, Artificial
  modif. frag.; CFP  F1E, w. F64L, S65T, and Y66W mutations, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 769 - protein, 173 aa, Artificial
  modif. frag.; CFP  F1E, w. F64L, S65T, and Y66W mutations, and posit. 1 Met removed
VSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 770 - DNA, 522 bp, Artificial
  modif. frag.; CFP  F1E, w. F64L, S65T, Y66W, N146I, M153T, and V163A mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggac

SEQ ID NO: 771 - protein, 174 aa, Artificial
  modif. frag.; CFP  F1E, w. F64L, S65T, Y66W, N146I, M153T, and V163A mutations
MVSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIED

SEQ ID NO: 772 - DNA, 519 bp, Artificial
  modif. frag.; CFP  F1E, w. F64L, S65T, Y66W, N146I, M153T, and V163A mutations, posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggac

SEQ ID NO: 773 - protein, 173 aa, Artificial
  modif. frag.; CFP  F1E, w. F64L, S65T, Y66W, N146I, M153T, and V163A mutations, posit. 1 Met removed
VSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIED

SEQ ID NO: 774 - DNA, 522 bp, Artificial
  modif. frag.; CFP  F1E, with  Y66W mutation
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 775 - protein, 174 aa, Artificial
  modif. frag.; CFP  F1E, with  Y66W mutation
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 776 - DNA, 519 bp, Artificial
  modif. frag.; CFP F1E, w. Y66W mutation, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 777 - protein, 173 aa, Artificial
  modif. frag.; CFP F1E, w. Y66W mutation, and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 778 - DNA, 522 bp, Artificial
  modif. frag.; CFP  F1E, with  Y66W, N146I mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggac

SEQ ID NO: 779 - protein, 174 aa, Artificial
  modif. frag.; CFP  F1E, with  Y66W, N146I mutations
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYIMADKQKNGIKVNFKIRHNIED

SEQ ID NO: 780 - DNA, 519 bp, Artificial
  modif. frag.; CFP F1E, w. Y66W, N146I mutations, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggac

SEQ ID NO: 781 - protein, 173 aa, Artificial
  modif. frag.; CFP F1E, w. Y66W, N146I mutations, and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYIMADKQKNGIKVNFKIRHNIED

SEQ ID NO: 782 - DNA, 522 bp, Artificial
  modif. frag.; CFP  F1E, with  M153T mutation
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggac

SEQ ID NO: 783 - protein, 174 aa, Artificial
  modif. frag.; CFP  F1E, with  M153T mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIED

SEQ ID NO: 784 - DNA, 519 bp, Artificial
  modif. frag.; CFP F1E, w. M153T  mutation, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggac

SEQ ID NO: 785 - protein, 173 aa, Artificial
  modif. frag.; CFP F1E, w. M153T  mutation, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIED

SEQ ID NO: 786 - DNA, 522 bp, Artificial
  modif. frag.; CFP  F1E, with N146I, M153T mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggac

SEQ ID NO: 787 - protein, 174 aa, Artificial
  modif. frag.; CFP  F1E, with N146I, M153T mutations
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIED

SEQ ID NO: 788 - DNA, 519 bp, Artificial
  modif. frag.; CFP F1E, w. N146I, M153T mutations, and posit.1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggac

SEQ ID NO: 789 - protein, 173 aa, Artificial
  modif. frag.; CFP F1E, w. N146I, M153T mutations, and posit.1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIED

SEQ ID NO: 790 - DNA, 522 bp, Artificial
  modif. frag.; CFP  F1E, w. N146I, M153T, V163A mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggac

SEQ ID NO: 791 - protein, 174 aa, Artificial
  modif. frag.; CFP  F1E, w. N146I, M153T, V163A mutations
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIED

SEQ ID NO: 792 - DNA, 519 bp, Artificial
  modif. frag.; CFP  F1E, w. N146I, M153T, V163A mutations, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggac

SEQ ID NO: 793 - protein, 173 aa, Artificial
  modif. frag.; CFP  F1E, w. N146I, M153T, V163A mutations, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIED

SEQ ID NO: 794 - DNA, 522 bp, Artificial
  modif. frag.; CFP  F1E, w. Y66W, N146I, and  M153T mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggac

SEQ ID NO: 795 - protein, 174 aa, Artificial
  modif. frag.; CFP  F1E, w. Y66W, N146I, and  M153T mutations
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIED

SEQ ID NO: 796 - DNA, 519 bp, Artificial
  modif. frag.; CFP  F1E, w. Y66W, N146I, and M153T mutations, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggac

SEQ ID NO: 797 - protein, 173 aa, Artificial
  modif. frag.; CFP  F1E, w. Y66W, N146I, and M153T mutations, and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIED

SEQ ID NO: 798 - DNA, 522 bp, Artificial
  modif. frag.; CFP F1E, w. Y66W, N146I, M153T, and V163A mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggac

SEQ ID NO: 799 - protein, 174 aa, Artificial
  modif. frag.; CFP F1E, w. Y66W, N146I, M153T, and V163A mutations
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIED

SEQ ID NO: 800 - DNA, 519 bp, Artificial
  modif. frag.; CFP  F1E, w. Y66W, N146I, M153T, and V163A mutations, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggac

SEQ ID NO: 801 - protein, 173 aa, Artificial
  modif. frag.; CFP  F1E, w. Y66W, N146I, M153T, and V163A mutations, and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIED

SEQ ID NO: 802 - DNA, 522 bp, Artificial
  modif. frag.; CFP F1E, with S65A mutation
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 803 - protein, 174 aa, Artificial
  modif. frag.; CFP F1E, with S65A mutation
MVSKGEELFTGVVPILVELDGDVNGHKFSVSGEGEGDATYGKLTLKFICTTGKLPVPWPTLVTTFAYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 804 - DNA, 519 bp, Artificial
  modif. frag.; CFP F1E, w. S65A mutation, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 805 - protein, 173 aa, Artificial
  modif. frag.; CFP F1E, w. S65A mutation, and posit. 1 Met removed
VSKGEELFTGVVPILVELDGDVNGHKFSVSGEGEGDATYGKLTLKFICTTGKLPVPWPTLVTTFAYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 806 - DNA, 522 bp, Artificial
  modif. frag.; CFP  F1E, w. S65A, Y66W, and S72A mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 807 - protein, 174 aa, Artificial
  modif. frag.; CFP  F1E, w. S65A, Y66W, and S72A mutations
MVSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 808 - DNA, 519 bp, Artificial
  modif. frag.; CFP  F1E, w. S65A, Y66W, and S72A mutations, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 809 - protein, 173 aa, Artificial
  modif. frag.; CFP  F1E, w. S65A, Y66W, and S72A mutations, and posit. 1 Met removed
VSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 810 - DNA, 522 bp, Artificial
  modif. frag.; CFP F1E, w. S65A, Y66W, S72A, N146I, M153T, and V163A mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggac

SEQ ID NO: 811 - protein, 174 aa, Artificial
  modif. frag.; CFP F1E, w. S65A, Y66W, S72A, N146I, M153T, and V163A mutations
MVSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIED

SEQ ID NO: 812 - DNA, 519 bp, Artificial
  modif. frag.; CFP F1E, w. S65A, Y66W, S72A, N146I, M153T, and V163A mutations, position 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggac

SEQ ID NO: 813 - protein, 173 aa, Artificial
  modif. frag.; CFP F1E, w. S65A, Y66W, S72A, N146I, M153T, and V163A mutations, position 1 Met removed
VSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIED

SEQ ID NO: 814 - DNA, 522 bp, Artificial
  modif. frag.; BFP  F1E, with Y66H mutation
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 815 - protein, 174 aa, Artificial
  modif. frag.; BFP  F1E, with Y66H mutation
MVSKGEELFTGVVPILVELDGDVNGHKFSVSGEGEGDATYGKLTLKFICTTGKLPVPWPTLVTTFGHGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 816 - DNA, 519 bp, Artificial
  modif. frag.; BFP F1E, w. Y66H mutation, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 817 - protein, 173 aa, Artificial
  modif. frag.; BFP F1E, w. Y66H mutation, and posit. 1 Met removed
VSKGEELFTGVVPILVELDGDVNGHKFSVSGEGEGDATYGKLTLKFICTTGKLPVPWPTLVTTFGHGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 818 - DNA, 522 bp, Artificial
  modif. frag.; BFP  F1E, with F64L, Y66H mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 819 - protein, 174 aa, Artificial
  modif. frag.; BFP  F1E, with F64L, Y66H mutations
MVSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 820 - DNA, 519 bp, Artificial
  modif. frag.; BFP F1E, w. F64L, Y66H mutations, and posit.1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 821 - protein, 173 aa, Artificial
  modif. frag.; BFP F1E, w. F64L, Y66H mutations, and posit.1 Met removed
VSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 822 - DNA, 522 bp, Artificial
  modif. frag.; BFP  F1E, w. F64L, Y66H, and Y145F mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggac

SEQ ID NO: 823 - protein, 174 aa, Artificial
  modif. frag.; BFP  F1E, w. F64L, Y66H, and Y145F mutations
MVSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIED

SEQ ID NO: 824 - DNA, 519 bp, Artificial
  modif. frag.; BFP F1E, w. F64L, Y66H, and Y145F mutations, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggac

SEQ ID NO: 825 - protein, 173 aa, Artificial
  modif. frag.; BFP F1E, w. F64L, Y66H, and Y145F mutations, and posit. 1 Met removed
VSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIED

SEQ ID NO: 826 - DNA, 522 bp, Artificial
  modif. frag.; BFP F1E, with Y145F mutation
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggac

SEQ ID NO: 827 - protein, 174 aa, Artificial
  modif. frag.; BFP F1E, with Y145F mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIED

SEQ ID NO: 828 - DNA, 519 bp, Artificial
  modif. frag.; BFP F1E, w. Y145F mutation, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggac

SEQ ID NO: 829 - protein, 173 aa, Artificial
  modif. frag.; BFP F1E, w. Y145F mutation, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIED

SEQ ID NO: 830 - DNA, 522 bp, Artificial
  modif. frag.; Venus  F1E, with F46L mutation
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 831 - protein, 174 aa, Artificial
  modif. frag.; Venus  F1E, with F46L mutation
MVSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 832 - DNA, 519 bp, Artificial
  modif. frag.; Venus F1E, w. F46L mutation, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 833 - protein, 173 aa, Artificial
  modif. frag.; Venus F1E, w. F46L mutation, and posit. 1 Met removed
VSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 834 - DNA, 522 bp, Artificial
  modif. frag.; Venus  F1E, with F46L, F64L mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 835 - protein, 174 aa, Artificial
  modif. frag.; Venus  F1E, with F46L, F64L mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 836 - DNA, 519 bp, Artificial
  modif. frag.; Venus  F1E, w. F46L, F64L mutations, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggac

SEQ ID NO: 837 - protein, 173 aa, Artificial
  modif. frag.; Venus  F1E, w. F46L, F64L mutations, and posit. 1 Met removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIED

SEQ ID NO: 838 - DNA, 522 bp, Artificial
  modif. frag.; Venus  F1E, with F46L, M153T mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggac

SEQ ID NO: 839 - protein, 174 aa, Artificial
  modif. frag.; Venus  F1E, with F46L, M153T mutations
MVSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIED

SEQ ID NO: 840 - DNA, 519 bp, Artificial
  modif. frag.; Venus  F1E, w. F46L, M153T mutations, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggac

SEQ ID NO: 841 - protein, 173 aa, Artificial
  modif. frag.; Venus  F1E, w. F46L, M153T mutations, and posit. 1 Met removed
VSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIED

SEQ ID NO: 842 - DNA, 522 bp, Artificial; identical to SEQ ID NO: 762
  modif. frag.; Venus  F1E, with F64L, M153T mutations
  CDS (1)..(522)

SEQ ID NO: 843 - protein, 174 aa, Artificial; identical to SEQ ID NO: 763
  modif. frag.; Venus  F1E, with F64L, M153T mutations

SEQ ID NO: 844 - DNA, 519 bp, Artificial; identical to SEQ ID NO: 764
  modif. frag.; Venus  F1E, w.F64L, M153T mutations, and posit. 1 Met removed
  CDS (1)..(519)

SEQ ID NO: 845 - protein, 173 aa, Artificial; identical to SEQ ID NO: 765
  modif. frag.; Venus  F1E, w.F64L, M153T mutations, and posit. 1 Met removed

SEQ ID NO: 846 - DNA, 522 bp, Artificial
  modif. frag.; Venus  F1E, w. F64L, M153T, and  V163A mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggac

SEQ ID NO: 847 - protein, 174 aa, Artificial
  modif. frag.; Venus  F1E, w. F64L, M153T, and  V163A mutations
MVSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIED

SEQ ID NO: 848 - DNA, 519 bp, Artificial
  modif. frag.; Venus  F1E, w.F64L, M153T, and V163A mutations, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggac

SEQ ID NO: 849 - protein, 173 aa, Artificial
  modif. frag.; Venus  F1E, w.F64L, M153T, and V163A mutations, and posit. 1 Met removed
VSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIED

SEQ ID NO: 850 - DNA, 522 bp, Artificial
  modif. frag.; Venus  F1E, w. F46L, M153T, and  V163A mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggac

SEQ ID NO: 851 - protein, 174 aa, Artificial
  modif. frag.; Venus  F1E, w. F46L, M153T, and  V163A mutations
MVSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIED

SEQ ID NO: 852 - DNA, 519 bp, Artificial
  modif. frag.; Venus  F1E, w. F46L, M153T, and  V163A mutations, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggac

SEQ ID NO: 853 - protein, 173 aa, Artificial
  modif. frag.; Venus  F1E, w. F46L, M153T, and  V163A mutations, and posit. 1 Met removed
VSKGEELFTGVVPILVELDGDVNGHKFSVSGEGEGDATYGKLTLKLICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIED

SEQ ID NO: 854 - DNA, 522 bp, Artificial
  modif. frag.; Venus  F1E, w. F46L, F64L, M153T, and V163A mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggac

SEQ ID NO: 855 - protein, 174 aa, Artificial
  modif. frag.; Venus  F1E, w. F46L, F64L, M153T, and V163A mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIED

SEQ ID NO: 856 - DNA, 519 bp, Artificial
  modif. frag.; Venus  F1E, w. F46L, F64L, M153T, and V163A mutations, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggac

SEQ ID NO: 857 - protein, 173 aa, Artificial
  modif. frag.; Venus  F1E, w. F46L, F64L, M153T, and V163A mutations, and posit. 1 Met removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIED

SEQ ID NO: 858 - DNA, 522 bp, Artificial
  modif. frag.; Venus  F1E, with V163A mutation
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggac

SEQ ID NO: 859 - protein, 174 aa, Artificial
  modif. frag.; Venus  F1E, with V163A mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIED

SEQ ID NO: 860 - DNA, 519 bp, Artificial
  modif. frag.; Venus F1E, w. V163A mutation, and posit. 1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggac

SEQ ID NO: 861 - protein, 173 aa, Artificial
  modif. frag.; Venus F1E, w. V163A mutation, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIED

SEQ ID NO: 862 - DNA, 522 bp, Artificial
  modif. frag.; Venus  F1E, with M153T, V163A mutations
  CDS (1)..(522)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggac

SEQ ID NO: 863 - protein, 174 aa, Artificial
  modif. frag.; Venus  F1E, with M153T, V163A mutations
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIED

SEQ ID NO: 864 - DNA, 519 bp, Artificial
  modif. frag.; Venus F1E, w. M153T, V163A mutations, and posit.1 Met removed
  CDS (1)..(519)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggac

SEQ ID NO: 865 - protein, 173 aa, Artificial
  modif. frag.; Venus F1E, w. M153T, V163A mutations, and posit.1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIED

SEQ ID NO: 866 - DNA, 198 bp, Artificial
  modif. frag.; YFP F2E, with Met added @ position 1
  CDS (1)..(198): YFP F2E corresponds to aa residues 175-end of YFP
atgggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 867 - protein, 66 aa, Artificial
  modif. frag.; YFP F2E, with Met added @ position 1
MGSVQLADHYQQNTPIGDGPVLLPDNHYLSYQSALSKDPNEKRDHMVLLEFVTAAGITLGMDELYK

SEQ ID NO: 868 - DNA, 195 bp, Artificial
  modif. frag.; YFP F2E, with Y203F mutation
  CDS (1)..(195)
ggcagcgtgcagctcgccgaccactaccagcagaacacccccatcggcgacggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 869 - protein, 65 aa, Artificial
  modif. frag.; YFP F2E, with Y203F mutation
GSVQLADHYQQNTPIGDGPVLLPDNHYLSFQSALSKDPNEKRDHMVLLEFVTAAGITLGMDELYK

SEQ ID NO: 870 - DNA, 198 bp, Artificial
  modif. frag.; YFP F2E, w. Y203F mutation, Met added @ posit. 1
  CDS (1)..(198)
atgggcagcgtgcagctcgccgaccactaccagcagaacacccccatcggcgacggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 871 - protein, 66 aa, Artificial
  modif. frag.; YFP F2E, w. Y203F mutation, Met added @ posit. 1
MGSVQLADHYQQNTPIGDGPVLLPDNHYLSFQSALSKDPNEKRDHMVLLEFVTAAGITLGMDELYK

SEQ ID NO: 872 - DNA, 195 bp, Artificial
  modif. frag.; YFP F2E, with Y203H mutation
  CDS (1)..(195)
ggcagcgtgcagctcgccgaccactaccagcagaacacccccatcggcgacggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 873 - protein, 65 aa, Artificial
  modif. frag.; YFP F2E, with Y203H mutation
GSVQLADHYQQNTPIGDGPVLLPDNHYLSHQSALSKDPNEKRDHMVLLEFVTAAGITLGMDELYK

SEQ ID NO: 874 - DNA, 198 bp, Artificial
  modif. frag.; YFP F2E, w. Y203H mutation, Met added @ posit. 1
  CDS (1)..(198)
atgggcagcgtgcagctcgccgaccactaccagcagaacacccccatcggcgacggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 875 - protein, 66 aa, Artificial
  modif. frag.; YFP F2E, w. Y203H mutation, Met added @ posit. 1
MGSVQLADHYQQNTPIGDGPVLLPDNHYLSHQSALSKDPNEKRDHMVLLEFVTAAGITLGMDELYK

SEQ ID NO: 876 - DNA, 195 bp, Artificial
  modif. frag.; Venus F2E, with S175G mutation
  CDS (1)..(195)
ggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 877 - protein, 65 aa, Artificial
  modif. frag.; Venus F2E, with S175G mutation
GGVQLADHYQQNTPIGDGPVLLPDNHYLSYQSALSKDPNEKRDHMVLLEFVTAAGITLGMDELYK

SEQ ID NO: 878 - DNA, 198 bp, Artificial
  modif. frag.; Venus F2E, w. S175G mutation , Met added @ posit. 1
  CDS (1)..(198)
atgggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 879 - protein, 66 aa, Artificial
  modif. frag.; Venus F2E, w. S175G mutation , Met added @ posit. 1
MGGVQLADHYQQNTPIGDGPVLLPDNHYLSYQSALSKDPNEKRDHMVLLEFVTAAGITLGMDELYK

SEQ ID NO: 880 - DNA, 195 bp, Artificial
  modif. frag.; Venus F2E, w. S175G, Y203T mutations
  CDS (1)..(195)
ggcggcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 881 - protein, 65 aa, Artificial
  modif. frag.; Venus F2E, w. S175G, Y203T mutations
GGVQLADHYQQNTPIGDGPVLLPDNHYLSTQSALSKDPNEKRDHMVLLEFVTAAGITLGMDELYK

SEQ ID NO: 882 - DNA, 198 bp, Artificial
  modif. frag.; Venus F2E, w. S175G, Y203T mutations, and Met added @ position 1
  CDS (1)..(198)
atgggcggcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 883 - protein, 66 aa, Artificial
  modif. frag.; Venus F2E, w. S175G, Y203T mutations, and Met added @ position 1
MGGVQLADHYQQNTPIGDGPVLLPDNHYLSTQSALSKDPNEKRDHMVLLEFVTAAGITLGMDELYK

SEQ ID NO: 884 - DNA, 195 bp, Artificial
  modif. frag.; Venus F2E, w. S175G, Y203F mutations
  CDS (1)..(195)
ggcggcgtgcagctcgccgaccactaccagcagaacacccccatcggcgacggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 885 - protein, 65 aa, Artificial
  modif. frag.; Venus F2E, w. S175G, Y203F mutations
GGVQLADHYQQNTPIGDGPVLLPDNHYLSFQSALSKDPNEKRDHMVLLEFVTAAGITLGMDELYK

SEQ ID NO: 886 - DNA, 198 bp, Artificial
  modif. frag.; Venus F2E, w. S175G, Y203F mutations, and Met added @ position 1
  CDS (1)..(198)
atgggcggcgtgcagctcgccgaccactaccagcagaacacccccatcggcgacggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 887 - protein, 66 aa, Artificial
  modif. frag.; Venus F2E, w. S175G, Y203F mutations, and Met added @ position 1
MGGVQLADHYQQNTPIGDGPVLLPDNHYLSFQSALSKDPNEKRDHMVLLEFVTAAGITLGMDELYK

SEQ ID NO: 888 - DNA, 570 bp, Artificial
  modif. frag.; YFP F1F, with position 1 Met removed
  CDS (1)..(570): YFP F1F corresponds to aa residues 1-191 of YFP
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 889 - protein, 190 aa, Artificial
  modif. frag.; YFP F1F, with position 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 890 - DNA, 573 bp, Artificial
  modif. frag.; YFP F1F, with K79R mutation
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgcgccggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 891 - protein, 191 aa, Artificial
  modif. frag.; YFP F1F, with K79R mutation
MVSKGEELFTGVVPILVELDGDVNGHKFSVSGEGEGDATYGKLTLKFICTTGKLPVPWPTLVTTFGYGLQCFARYPDHMRRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 892 - DNA, 570 bp, Artificial
  modif. frag.; YFP F1F, w. K79R mutation, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgcgccggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 893 - protein, 190 aa, Artificial
  modif. frag.; YFP F1F, w. K79R mutation, and posit. 1 Met removed
VSKGEELFTGVVPILVELDGDVNGHKFSVSGEGEGDATYGKLTLKFICTTGKLPVPWPTLVTTFGYGLQCFARYPDHMRRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 894 - DNA, 573 bp, Artificial
  modif. frag.; YFP F1F, with Y66F mutation
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 895 - protein, 191 aa, Artificial
  modif. frag.; YFP F1F, with Y66F mutation
MVSKGEELFTGVVPILVELDGDVNGHKFSVSGEGEGDATYGKLTLKFICTTGKLPVPWPTLVTTFGFGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 896 - DNA, 570 bp, Artificial
  modif. frag.; YFP F1F, w. Y66F mutation, and  posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggcttcggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 897 - protein, 190 aa, Artificial
  modif. frag.; YFP F1F, w. Y66F mutation, and  posit. 1 Met removed
VSKGEELFTGVVPILVELDGDVNGHKFSVSGEGEGDATYGKLTLKFICTTGKLPVPWPTLVTTFGFGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 898 - DNA, 573 bp, Artificial
  modif. frag.; YFP F1F, with Q69K mutation
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 899 - protein, 191 aa, Artificial
  modif. frag.; YFP F1F, with Q69K mutation
MVSKGEELFTGVVPILVELDGDVNGHKFSVSGEGEGDATYGKLTLKFICTTGKLPVPWPTLVTTFGYGLKCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 900 - DNA, 570 bp, Artificial
  modif. frag.; YFP F1F, w. Q69K mutation, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgaagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 901 - protein, 190 aa, Artificial
  modif. frag.; YFP F1F, w. Q69K mutation, and posit. 1 Met removed
VSKGEELFTGVVPILVELDGDVNGHKFSVSGEGEGDATYGKLTLKFICTTGKLPVPWPTLVTTFGYGLKCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 902 - DNA, 573 bp, Artificial
  modif. frag.; citrine F1F, w. V68L, Q69M mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 903 - protein, 191 aa, Artificial
  modif. frag.; citrine F1F, w. V68L, Q69M mutations
MVSKGEELFTGVVPILVELDGDVNGHKFSVSGEGEGDATYGKLTLKFICTTGKLPVPWPTLVTTFGYGLMCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 904 - DNA, 570 bp, Artificial
  modif. frag.; citrine F1F, w. V68L, Q69M mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 905 - protein, 190 aa, Artificial
  modif. frag.; citrine F1F, w. V68L, Q69M mutations, and posit. 1 Met removed
VSKGEELFTGVVPILVELDGDVNGHKFSVSGEGEGDATYGKLTLKFICTTGKLPVPWPTLVTTFGYGLMCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 906 - DNA, 573 bp, Artificial
  modif. frag.; CFP F1F, with F64L mutation
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 907 - protein, 191 aa, Artificial
  modif. frag.; CFP F1F, with F64L mutation
MVSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 908 - DNA, 570 bp, Artificial
  modif. frag.; CFP F1F, w. F64L mutation, posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 909 - protein, 190 aa, Artificial
  modif. frag.; CFP F1F, w. F64L mutation, posit. 1 Met removed
VSKGEELFTGVVPILVELDGDVNGHKFSVSGEGEGDATYGKLTLKFICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 910 - DNA, 573 bp, Artificial
  modif. frag.; CFP F1F, w. F64L, S65T, and Y66W mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 911 - protein, 191 aa, Artificial
  modif. frag.; CFP F1F, w. F64L, S65T, and Y66W mutations
MVSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 912 - DNA, 570 bp, Artificial
  modif. frag.; CFP F1F, w. F64L, S65T, and Y66W mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 913 - protein, 190 aa, Artificial
  modif. frag.; CFP F1F, w. F64L, S65T, and Y66W mutations, and posit. 1 Met removed
VSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 914 - DNA, 573 bp, Artificial
  modif. frag.; CFP F1F, w. F64L, S65T, Y66W, N146I, M153T, and V163A mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgac

SEQ ID NO: 915 - protein, 191 aa, Artificial
  modif. frag.; CFP F1F, w. F64L, S65T, Y66W, N146I, M153T, and V163A mutations
MVSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGD

SEQ ID NO: 916 - DNA, 570 bp, Artificial
  modif. frag.; CFP F1F, w. F64L, S65T, Y66W, N146I, M153T, and V163A mutations, and position 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgac

SEQ ID NO: 917 - protein, 190 aa, Artificial
  modif. frag.; CFP F1F, w. F64L, S65T, Y66W, N146I, M153T, and V163A mutations, and position 1 Met removed
VSKGEELFTGVVPILVELDGDVNGHKFSVSGEGEGDATYGKLTLKFICTTGKLPVPWPTLVTTLTWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGD

SEQ ID NO: 918 - DNA, 573 bp, Artificial
  modif. frag.; CFP F1F, with Y66W mutation
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 919 - protein, 191 aa, Artificial
  modif. frag.; CFP F1F, with Y66W mutation
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 920 - DNA, 570 bp, Artificial
  modif. frag.; CFP F1F, w. Y66W mutation, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 921 - protein, 190 aa, Artificial
  modif. frag.; CFP F1F, w. Y66W mutation, and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 922 - DNA, 573 bp, Artificial
  modif. frag.; CFP F1F, w. Y66W, N146I mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 923 - protein, 191 aa, Artificial
  modif. frag.; CFP F1F, w. Y66W, N146I mutations
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYIMADKQKNGIKVNFKIRHNIEDGSVQLADHYQQNTPIGD

SEQ ID NO: 924 - DNA, 570 bp, Artificial
  modif. frag.; CFP F1F, w. Y66W, N146I mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 925 - protein, 190 aa, Artificial
  modif. frag.; CFP F1F, w. Y66W, N146I mutations, and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYIMADKQKNGIKVNFKIRHNIEDGSVQLADHYQQNTPIGD

SEQ ID NO: 926 - DNA, 573 bp, Artificial
  modif. frag.; CFP F1F, with M153T  mutation
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgac

SEQ ID NO: 927 - protein, 191 aa, Artificial
  modif. frag.; CFP F1F, with M153T  mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIEDGSVQLADHYQQNTPIGD

SEQ ID NO: 928 - DNA, 570 bp, Artificial
  modif. frag.; CFP F1F, w. M153T mutation, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgac

SEQ ID NO: 929 - protein, 190 aa, Artificial
  modif. frag.; CFP F1F, w. M153T mutation, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIEDGSVQLADHYQQNTPIGD

SEQ ID NO: 930 - DNA, 573 bp, Artificial
  modif. frag.; CFP F1F, with M153T  mutation
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgac

SEQ ID NO: 931 - protein, 191 aa, Artificial
  modif. frag.; CFP F1F, with M153T  mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIEDGSVQLADHYQQNTPIGD

SEQ ID NO: 932 - DNA, 570 bp, Artificial
  modif. frag.; CFP F1F, w. N146I, M153T mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgac

SEQ ID NO: 933 - protein, 190 aa, Artificial
  modif. frag.; CFP F1F, w. N146I, M153T mutations, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIEDGSVQLADHYQQNTPIGD

SEQ ID NO: 934 - DNA, 573 bp, Artificial
  modif. frag.; CFP F1F, w. N146I,  M153T, and V163A  mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgac

SEQ ID NO: 935 - protein, 191 aa, Artificial
  modif. frag.; CFP F1F, w. N146I,  M153T, and V163A  mutations
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGD

SEQ ID NO: 936 - DNA, 570 bp, Artificial
  modif. frag.; CFP F1F, w. N146I, M153T, and V163A  mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgac

SEQ ID NO: 937 - protein, 190 aa, Artificial
  modif. frag.; CFP F1F, w. N146I, M153T, and V163A  mutations, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGD

SEQ ID NO: 938 - DNA, 573 bp, Artificial
  modif. frag.; CFP F1F, w. Y66W, N146I, and  M153T mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgac

SEQ ID NO: 939 - protein, 191 aa, Artificial
  modif. frag.; CFP F1F, w. Y66W, N146I, and  M153T mutations
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIEDGSVQLADHYQQNTPIGD

SEQ ID NO: 940 - DNA, 570 bp, Artificial
  modif. frag.; CFP F1F, w. Y66W, N146I, and M153T mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggtgaacttcaagatccgccacaacatcgaggacggcagcgtgcagctcgccgaccactaccagcagaacacccccatcggcgac

SEQ ID NO: 941 - protein, 190 aa, Artificial
  modif. frag.; CFP F1F, w. Y66W, N146I, and M153T mutations, and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKVNFKIRHNIEDGSVQLADHYQQNTPIGD

SEQ ID NO: 942 - DNA, 573 bp, Artificial
  modif. frag.; CFP F1F, w. Y66W, N146I,  M153T, and V163A mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgac

SEQ ID NO: 943 - protein, 191 aa, Artificial
  modif. frag.; CFP F1F, w. Y66W, N146I,  M153T, and V163A mutations
MVSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGD

SEQ ID NO: 944 - DNA, 570 bp, Artificial
  modif. frag.; CFP F1F, w. Y66W, N146I,  M153T, and V163A mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgac

SEQ ID NO: 945 - protein, 190 aa, Artificial
  modif. frag.; CFP F1F, w. Y66W, N146I,  M153T, and V163A mutations, and posit. 1 Met removed
VSKGEELFTGVVPILVELDGDVNGHKFSVSGEGEGDATYGKLTLKFICTTGKLPVPWPTLVTTFGWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGD

SEQ ID NO: 946 - DNA, 573 bp, Artificial
  modif. frag.; CFP F1F, with S65A  mutation
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 947 - protein, 191 aa, Artificial
  modif. frag.; CFP F1F, with S65A  mutation
MVSKGEELFTGVVPILVELDGDVNGHKFSVSGEGEGDATYGKLTLKFICTTGKLPVPWPTLVTTFAYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 948 - DNA, 570 bp, Artificial
  modif. frag.; CFP F1F, w. S65A  mutation, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 949 - protein, 190 aa, Artificial
  modif. frag.; CFP F1F, w. S65A  mutation, and posit. 1 Met removed
VSKGEELFTGVVPILVELDGDVNGHKFSVSGEGEGDATYGKLTLKFICTTGKLPVPWPTLVTTFAYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 950 - DNA, 573 bp, Artificial
  modif. frag.; CFP F1F, w. S65A, Y66W, and S72A mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 951 - protein, 191 aa, Artificial
  modif. frag.; CFP F1F, w. S65A, Y66W, and S72A mutations
MVSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 952 - DNA, 570 bp, Artificial
  modif. frag.; CFP F1F, w. S65A, Y66W, and S72A mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 953 - protein, 190 aa, Artificial
  modif. frag.; CFP F1F, w. S65A, Y66W, and S72A mutations, and posit. 1 Met removed
VSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 954 - DNA, 573 bp, Artificial
  modif. frag.; CFP F1F, w. S65A, Y66W, S72A, N146I, M153T, and V163A mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgac

SEQ ID NO: 955 - protein, 191 aa, Artificial
  modif. frag.; CFP F1F, w. S65A, Y66W, S72A, N146I, M153T, and V163A mutations
MVSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGD

SEQ ID NO: 956 - DNA, 570 bp, Artificial
  modif. frag.; CFP F1F, w. S65A, Y66W, S72A, N146I, M153T, and V163A mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcgcctggggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgac

SEQ ID NO: 957 - protein, 190 aa, Artificial
  modif. frag.; CFP F1F, w. S65A, Y66W, S72A, N146I, M153T, and V163A mutations, and posit. 1 Met removed
VSKGEELFTGVVPILVELDGDVNGHKFSVSGEGEGDATYGKLTLKFICTTGKLPVPWPTLVTTFAWGLQCFARYPDHMKRHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGD

SEQ ID NO: 958 - DNA, 573 bp, Artificial
  modif. frag.; BFP F1F, with Y66H mutation
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 959 - protein, 191 aa, Artificial
  modif. frag.; BFP F1F, with Y66H mutation
MVSKGEELFTGVVPILVELDGDVNGHKFSVSGEGEGDATYGKLTLKFICTTGKLPVPWPTLVTTFGHGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 960 - DNA, 570 bp, Artificial
  modif. frag.; BFP F1F, w. Y66H mutation, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 961 - protein, 190 aa, Artificial
  modif. frag.; BFP F1F, w. Y66H mutation, and posit. 1 Met removed
VSKGEELFTGVVPILVELDGDVNGHKFSVSGEGEGDATYGKLTLKFICTTGKLPVPWPTLVTTFGHGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 962 - DNA, 573 bp, Artificial
  modif. frag.; BFP F1F, w. F64L, Y66H mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 963 - protein, 191 aa, Artificial
  modif. frag.; BFP F1F, w. F64L, Y66H mutations
MVSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 964 - DNA, 570 bp, Artificial
  modif. frag.; BFP F1F, w. F64L, Y66H mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 965 - protein, 190 aa, Artificial
  modif. frag.; BFP F1F, w. F64L, Y66H mutations, and posit. 1 Met removed
VSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGD

SEQ ID NO: 966 - DNA, 573 bp, Artificial
  modif. frag.; BFP F1F, w. F64L, Y66H, and Y145F mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 967 - protein, 191 aa, Artificial
  modif. frag.; BFP F1F, w. F64L, Y66H, and Y145F mutations
MVSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGD

SEQ ID NO: 968 - DNA, 570 bp, Artificial
  modif. frag.; BFP F1F, w. F64L, Y66H, and Y145F mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggccacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 969 - protein, 190 aa, Artificial
  modif. frag.; BFP F1F, w. F64L, Y66H, and Y145F mutations, and posit. 1 Met removed
VSKGEELFTGVVPILVELDGDVNGHKFSVSGEGEGDATYGKLTLKFICTTGKLPVPWPTLVTTLGHGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGD

SEQ ID NO: 970 - DNA, 573 bp, Artificial
  modif. frag.; BFP F1F, with Y145F mutation
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 971 - protein, 191 aa, Artificial
  modif. frag.; BFP F1F, with Y145F mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGD

SEQ ID NO: 972 - DNA, 570 bp, Artificial
  modif. frag.; BFP F1F, w. Y145F mutation, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcatggccgacaagcagaagaacggcatcaaggtgaacttcaagatccgccacaacatcgaggacggcagcgtgcagctcgccgaccactaccagcagaacacccccatcggcgac

SEQ ID NO: 973 - protein, 190 aa, Artificial
  modif. frag.; BFP F1F, w. Y145F mutation, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGD

SEQ ID NO: 974 - DNA, 573 bp, Artificial
  modif. frag.; Venus F1F, w. F46L, F64L, M153T, V163A mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgac

SEQ ID NO: 975 - protein, 191 aa, Artificial
  modif. frag.; Venus F1F, w. F46L, F64L, M153T, V163A mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIEDGSVQLADHYQQNTPIGD

SEQ ID NO: 976 - DNA, 570 bp, Artificial
  modif. frag.; Venus F1F, w. F46L, F64L, M153T, V163A mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcagcgtgcagctcgccgaccactaccagcagaacacccccatcggcgac

SEQ ID NO: 977 - protein, 190 aa, Artificial
  modif. frag.; Venus F1F, w. F46L, F64L, M153T, V163A mutations, and posit. 1 Met removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIEDGSVQLADHYQQNTPIGD

SEQ ID NO: 978 - DNA, 573 bp, Artificial
  modif. frag.; Venus F1F, with V163A mutation
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgac

SEQ ID NO: 979 - protein, 191 aa, Artificial
  modif. frag.; Venus F1F, with V163A mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIEDGSVQLADHYQQNTPIGD

SEQ ID NO: 980 - DNA, 570 bp, Artificial
  modif. frag.; Venus F1F, w. V163A mutation, posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcagcgtgcagctcgccgaccactaccagcagaacacccccatcggcgac

SEQ ID NO: 981 - protein, 190 aa, Artificial
  modif. frag.; Venus F1F, w. V163A mutation, posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIEDGSVQLADHYQQNTPIGD

SEQ ID NO: 982 - DNA, 573 bp, Artificial
  modif. frag.; Venus F1F, w. M153T, V163A mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgac

SEQ ID NO: 983 - protein, 191 aa, Artificial
  modif. frag.; Venus F1F, w. M153T, V163A mutations
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGSVQLADHYQQNTPIGD

SEQ ID NO: 984 - DNA, 570 bp, Artificial
  modif. frag.; Venus F1F, w. M153T, V163A mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcagcgtgcagctcgccgaccactaccagcagaacacccccatcggcgac

SEQ ID NO: 985 - protein, 190 aa, Artificial
  modif. frag.; Venus F1F, w. M153T, V163A mutations, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGSVQLADHYQQNTPIGD

SEQ ID NO: 986 - DNA, 573 bp, Artificial
  modif. frag.; Venus F1F, with S175G mutation
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcggcgtgcagctcgccgaccactaccagcagaacacccccatcggcgac

SEQ ID NO: 987 - protein, 191 aa, Artificial
  modif. frag.; Venus F1F, with S175G mutation
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGGVQLADHYQQNTPIGD

SEQ ID NO: 988 - DNA, 570 bp, Artificial
  modif. frag.; Venus F1F, w. S175G mutation, posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcggcgtgcagctcgccgaccactaccagcagaacacccccatcggcgac

SEQ ID NO: 989 - protein, 190 aa, Artificial
  modif. frag.; Venus F1F, w. S175G mutation, posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGGVQLADHYQQNTPIGD

SEQ ID NO: 990 - DNA, 573 bp, Artificial
  modif. frag.; Venus F1F, w. M153T, S175G mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcggcgtgcagctcgccgaccactaccagcagaacacccccatcggcgac

SEQ ID NO: 991 - protein, 191 aa, Artificial
  modif. frag.; Venus F1F, w. M153T, S175G mutations
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIEDGGVQLADHYQQNTPIGD

SEQ ID NO: 992 - DNA, 570 bp, Artificial
  modif. frag.; Venus F1F, w. M153T, S175G mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggtgaacttcaagatccgccacaacatcgaggacggcggcgtgcagctcgccgaccactaccagcagaacacccccatcggcgac

SEQ ID NO: 993 - protein, 190 aa, Artificial
  modif. frag.; Venus F1F, w. M153T, S175G mutations, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKVNFKIRHNIEDGGVQLADHYQQNTPIGD

SEQ ID NO: 994 - DNA, 573 bp, Artificial
  modif. frag.; Venus F1F, w. V163A, S175G mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcggcgtgcagctcgccgaccactaccagcagaacacccccatcggcgac

SEQ ID NO: 995 - protein, 191 aa, Artificial
  modif. frag.; Venus F1F, w. V163A, S175G mutations
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIEDGGVQLADHYQQNTPIGD

SEQ ID NO: 996 - DNA, 570 bp, Artificial
  modif. frag.; Venus F1F, w. V163A, S175G mutations, and posit.1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggccaacttcaagatccgccacaacatcgaggacggcggcgtgcagctcgccgaccactaccagcagaacacccccatcggcgac

SEQ ID NO: 997 - protein, 190 aa, Artificial
  modif. frag.; Venus F1F, w. V163A, S175G mutations, and posit.1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIEDGGVQLADHYQQNTPIGD

SEQ ID NO: 998 - DNA, 573 bp, Artificial
  modif. frag.; Venus F1F, w. M153T, V163A, and S175G mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgac

SEQ ID NO: 999 - protein, 191 aa, Artificial
  modif. frag.; Venus F1F, w. M153T, V163A, and S175G mutations
MVSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGD

SEQ ID NO: 1000 - DNA, 570 bp, Artificial
  modif. frag.; Venus F1F, w. M153T, V163A, and S175G mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgac

SEQ ID NO: 1001 - protein, 190 aa, Artificial
  modif. frag.; Venus F1F, w. M153T, V163A, and S175G mutations, and posit. 1 Met removed
VSKGEELFTGVVPILVELDGDVNGHKFSVSGEGEGDATYGKLTLKFICTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGD

SEQ ID NO: 1002 - DNA, 573 bp, Artificial
  modif. frag.; Venus F1F, w. F46L, F64L, M153T, V163A, and S175G mutations
  CDS (1)..(573)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgac

SEQ ID NO: 1003 - protein, 191 aa, Artificial
  modif. frag.; Venus F1F, w. F46L, F64L, M153T, V163A, and S175G mutations
MVSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGD

SEQ ID NO: 1004 - DNA, 570 bp, Artificial
  modif. frag.; Venus F1F, w. F46L, F64L, M153T, V163A, and S175G mutations, and posit. 1 Met removed
  CDS (1)..(570)
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcggcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgac

SEQ ID NO: 1005 - protein, 190 aa, Artificial
  modif. frag.; Venus F1F, w. F46L, F64L, M153T, V163A, and S175G mutations, and posit. 1 Met removed
VSKGEELFTGVVPILVELDGDVNGHKFSVSGEGEGDATYGKLTLKLICTTGKLPVPWPTLVTTLGYGLQCFARYPDHMKRHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGD

SEQ ID NO: 1006 - DNA, 147 bp, Artificial
  modif. frag.; YFP F2F, with Met added @ position 1
  CDS (1)..(147): YFP F2F corresponds to aa residues 192-end of YFP
atgggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaag

SEQ ID NO: 1007 - protein, 49 aa, Artificial
  modif. frag.; YFP F2F, with Met added @ position 1
MGPVLLPDNHYLSYQSALSKDPNEKRDHMVLLEFVTAAGITLGMDELYK

SEQ ID NO: 1008 - DNA, 144 bp, Artificial
  modif. frag.; YFP F2F, with Y203F mutation
  CDS (1)..(144)
ggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 1009 - protein, 48 aa, Artificial
  modif. frag.; YFP F2F, with Y203F mutation
GPVLLPDNHYLSFQSALSKDPNEKRDHMVLLEFVTAAGITLGMDELYK

SEQ ID NO: 1010 - DNA, 147 bp, Artificial
  modif. frag.; YFP F2F, w. Y203F mutation, Met added @ posit. 1
  CDS (1)..(147)
atgggccccgtgctgctgcccgacaaccactacctgagcttccagtccgccctgagcaaagaccccaacgagaagcgcgatcacatggtcctgctggagttcgtgaccgccgccgggatcactctcggcatggacgagctgtacaag

SEQ ID NO: 1011 - protein, 49 aa, Artificial
  modif. frag.; YFP F2F, w. Y203F mutation, Met added @ posit. 1
MGPVLLPDNHYLSFQSALSKDPNEKRDHMVLLEFVTAAGITLGMDELYK

SEQ ID NO: 1012 - DNA, 144 bp, Artificial
  modif. frag.; YFP F2F, with Y203H mutation
  CDS (1)..(144)
ggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 1013 - protein, 48 aa, Artificial
  modif. frag.; YFP F2F, with Y203H mutation
GPVLLPDNHYLSHQSALSKDPNEKRDHMVLLEFVTAAGITLGMDELYK

SEQ ID NO: 1014 - DNA, 147 bp, Artificial
  modif. frag.; YFP F2F, w. Y203H mutation, Met added @ posit. 1
  CDS (1)..(147)
atgggccccgtgctgctgcccgacaaccactacctgagccaccagtccgccctgagcaaagaccccaacgagaagcgcgatcacatggtcctgctggagttcgtgaccgccgccgggatcactctcggcatggacgagctgtacaag

SEQ ID NO: 1015 - protein, 49 aa, Artificial
  modif. frag.; YFP F2F, w. Y203H mutation, Met added @ posit. 1
MGPVLLPDNHYLSHQSALSKDPNEKRDHMVLLEFVTAAGITLGMDELYK

SEQ ID NO: 1016 - DNA, 144 bp, Artificial
  modif. frag.; YFP F2F, with Y203T mutation
  CDS (1)..(144)
ggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 1017 - protein, 48 aa, Artificial
  modif. frag.; YFP F2F, with Y203T mutation
GPVLLPDNHYLSTQSALSKDPNEKRDHMVLLEFVTAAGITLGMDELYK

SEQ ID NO: 1018 - DNA, 147 bp, Artificial
  modif. frag.; YFP F2F, w. Y203T mutation, Met added @ posit. 1
  CDS (1)..(147)
atgggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 1019 - protein, 49 aa, Artificial
  modif. frag.; YFP F2F, w. Y203T mutation, Met added @ posit. 1
MGPVLLPDNHYLSTQSALSKDPNEKRDHMVLLEFVTAAGITLGMDELYK

SEQ ID NO: 1020 - DNA, 114 bp, Artificial
  modif. frag.;  RFP F1A, with position 1 Met removed
  CDS (1)..(114): RFP F1A corresponds to aa residues 1-39 of mRFP
gcctcctccgaggacgtcatcaaggagttcatgcgcttcaaggtgcgcatggagggctccgtgaacggccacgagttcgagatcgagggcgagggcgagggccgcccctacgag

SEQ ID NO: 1021 - protein, 38 aa, Artificial
  modif. frag.;  RFP F1A, with position 1 Met removed
ASSEDVIKEFMRFKVRMEGSVNGHEFEIEGEGEGRPYE

SEQ ID NO: 1022 - DNA, 561 bp, Artificial
  modif. frag.;  RFP F2A, with Met added @ position 1
  CDS (1)..(561): RFP F2A corresponds to aa residues 40-end of mRFP
atgggcacccagaccgccaagctgaaggtgaccaagggcggccccctgcccttcgcctgggacatcctgtcccctcagttccagtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctccaccgagcggatgtaccccgaggacggcgccctgaagggcgagatcaagatgaggctgaagctgaaggacggcggccactacgacgccgaggtcaagaccacctacatggccaagaagcccgtgcagctgcccggcgcctacaagaccgacatcaagctggacatcacctcccacaacgaggactacaccatcgtggaacagtacgagcgcgccgagggccgccactccaccggcgcc

SEQ ID NO: 1023 - protein, 187 aa, Artificial
  modif. frag.;  RFP F2A, with Met added @ position 1
MGTQTAKLKVTKGGPLPFAWDILSPQFQYGSKAYVKHPADIPDYLKLSFPEGFKWERVMNFEDGGVVTVTQDSSLQDGEFIYKVKLRGTNFPSDGPVMQKKTMGWEASTERMYPEDGALKGEIKMRLKLKDGGHYDAEVKTTYMAKKPVQLPGAYKTDIKLDITSHNEDYTIVEQYERAEGRHSTGA

SEQ ID NO: 1024 - DNA, 300 bp, Artificial
  modif. frag.;  RFP F1B, with position 1 Met removed
  CDS (1)..(300): RFP F1B corresponds to aa residues 1-100 of mRFP
gcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttccagtacggctccaaggcctacgtgaagcaccccgccgacatccccgactacttgaagctgtccttccccgagggcttcaagtgggagcgcgtgatgaacttcgaggac

SEQ ID NO: 1025 - protein, 100 aa, Artificial
  modif. frag.;  RFP F1B, with position 1 Met removed
ASSEDVIKEFMRFKVRMEGSVNGHEFEIEGEGEGRPYEGTQTAKLKVTKGGPLPFAWDILSPQFQYGSKAYVKHPADIPDYLKLSFPEGFKWERVMNFED

SEQ ID NO: 1026 - DNA, 375 bp, Artificial
  modif. frag.;  RFP F2B, with  Met added @ position 1
  CDS (1)..(375): RFP F2B corresponds to aa residues 102-225(end) of mRFP
atgggcggcgtggtgaccgtgacccaggactcctccctgcaggacggcgagttcatctacaaggtgaagctgcgcggcaccaacttcccctccgacggccccgtaatgcagaagaagaccatgggctgggaggcctccaccgagcggatgtaccccgaggacggcgccctgaagggcgagatcaagatgaggctgaagctgaaggacggcggccactacgacgccgaggtcaagaccacctacatggccaagaagcccgtgcagctgcccggcgcctacaagaccgacatcaagctggacatcacctcccacaacgaggactacaccatcgtggaacagtacgagcgcgccgagggccgccactccaccggcgcc

SEQ ID NO: 1027 - protein, 125 aa, Artificial
  modif. frag.;  RFP F2B, with  Met added @ position 1
MGGVVTVTQDSSLQDGEFIYKVKLRGTNFPSDGPVMQKKTMGWEASTERMYPEDGALKGEIKMRLKLKDGGHYDAEVKTTYMAKKPVQLPGAYKTDIKLDITSHNEDYTIVEQYERAEGRHSTGA

SEQ ID NO: 1028 - DNA, 342 bp, Artificial
  modif. frag.; RFP F1C, with position 1 Met removed
  CDS (1)..(342): RFP F1C corresponds to aa residues 1-115 of mRFP
gcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttccagtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggac

SEQ ID NO: 1029 - protein, 114 aa, Artificial
  modif. frag.; RFP F1C, with position 1 Met removed
ASSEDVIKEFMRFKVRMEGSVNGHEFEIEGEGEGRPYEGTQTAKLKVTKGGPLPFAWDILSPQFQYGSKAYVKHPADIPDYLKLSFPEGFKWERVMNFEDGGVVTVTQDSSLQD

SEQ ID NO: 1030 - DNA, 333 bp, Artificial
  modif. frag.; RFP F2C, with Met added @ position 1
  CDS (1)..(333): RFP F2C corresponds to aa residues 116-225(end) of mRFP
atgggcgagttcatctacaaggtgaagctgcgcggcaccaacttcccctccgacggccccgtaatgcagaagaagaccatgggctgggaggcctccaccgagcggatgtaccccgaggacggcgccctgaagggcgagatcaagatgaggctgaagctgaaggacggcggccactacgacgccgaggtcaagaccacctacatggccaagaagcccgtgcagctgcccggcgcctacaagaccgacatcaagctggacatcacctcccacaacgaggactacaccatcgtggaacagtacgagcgcgccgagggccgccactccaccggcgcc

SEQ ID NO: 1031 - protein, 111 aa, Artificial
  modif. frag.; RFP F2C, with Met added @ position 1
MGEFIYKVKLRGTNFPSDGPVMQKKTMGWEASTERMYPEDGALKGEIKMRLKLKDGGHYDAEVKTTYMAKKPVQLPGAYKTDIKLDITSHNEDYTIVEQYERAEGRHSTGA

SEQ ID NO: 1032 - DNA, 456 bp, Artificial
  modif. frag.;  RFP F1D, with position 1 Met removed
  CDS (1)..(456): RFP F1D corresponds to aa residues 1-153 of mRFP
gcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttccagtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctccaccgagcggatgtaccccgag

SEQ ID NO: 1033 - protein, 152 aa, Artificial
  modif. frag.;  RFP F1D, with position 1 Met removed
ASSEDVIKEFMRFKVRMEGSVNGHEFEIEGEGEGRPYEGTQTAKLKVTKGGPLPFAWDILSPQFQYGSKAYVKHPADIPDYLKLSFPEGFKWERVMNFEDGGVVTVTQDSSLQDGEFIYKVKLRGTNFPSDGPVMQKKTMGWEASTERMYPE

SEQ ID NO: 1034 - DNA, 219 bp, Artificial
  modif. frag.; RFP F2D, with Met added @ position 1
  CDS (1)..(219): RFP F2D corresponds to aa residues 154-225(end) of mRFP
atggacggcgccctgaagggcgagatcaagatgaggctgaagctgaaggacggcggccactacgacgccgaggtcaagaccacctacatggccaagaagcccgtgcagctgcccggcgcctacaagaccgacatcaagctggacatcacctcccacaacgaggactacaccatcgtggaacagtacgagcgcgccgagggccgccactccaccggcgcc

SEQ ID NO: 1035 - protein, 73 aa, Artificial
  modif. frag.; RFP F2D, with Met added @ position 1
MDGALKGEIKMRLKLKDGGHYDAEVKTTYMAKKPVQLPGAYKTDIKLDITSHNEDYTIVEQYERAEGRHSTGA

SEQ ID NO: 1036 - DNA, 504 bp, Artificial
  modif. frag.; RFP F1E, with position 1 Met removed
  CDS (1)..(504): RFP F1E corresponds to aa residues 1-169 of mRFP
gcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttccagtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctccaccgagcggatgtaccccgaggacggcgccctgaagggcgagatcaagatgaggctgaagctgaaggac

SEQ ID NO: 1037 - protein, 168 aa, Artificial
  modif. frag.; RFP F1E, with position 1 Met removed
ASSEDVIKEFMRFKVRMEGSVNGHEFEIEGEGEGRPYEGTQTAKLKVTKGGPLPFAWDILSPQFQYGSKAYVKHPADIPDYLKLSFPEGFKWERVMNFEDGGVVTVTQDSSLQDGEFIYKVKLRGTNFPSDGPVMQKKTMGWEASTERMYPEDGALKGEIKMRLKLKD

SEQ ID NO: 1038 - DNA, 171 bp, Artificial
  modif. frag.; RFP F2E, with Met added @ position 1
  CDS (1)..(171): RFP F2E corresponds to aa residues 170-225(end) of mRFP
atgggcggccactacgacgccgaggtcaagaccacctacatggccaagaagcccgtgcagctgcccggcgcctacaagaccgacatcaagctggacatcacctcccacaacgaggactacaccatcgtggaacagtacgagcgcgccgagggccgccactccaccggcgcc

SEQ ID NO: 1039 - protein, 57 aa, Artificial
  modif. frag.; RFP F2E, with Met added @ position 1
MGGHYDAEVKTTYMAKKPVQLPGAYKTDIKLDITSHNEDYTIVEQYERAEGRHSTGA

SEQ ID NO: 1040 - DNA, 549 bp, Artificial
  modif. frag.;  RFP F1F, with position 1 Met removed
  CDS (1)..(549): RFP F1F  corresponds to aa residues 1-184 of mRFP
gcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttccagtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctccaccgagcggatgtaccccgaggacggcgccctgaagggcgagatcaagatgaggctgaagctgaaggacggcggccactacgacgccgaggtcaagaccacctacatggccaag

SEQ ID NO: 1041 - protein, 183 aa, Artificial
  modif. frag.;  RFP F1F, with position 1 Met removed
ASSEDVIKEFMRFKVRMEGSVNGHEFEIEGEGEGRPYEGTQTAKLKVTKGGPLPFAWDILSPQFQYGSKAYVKHPADIPDYLKLSFPEGFKWERVMNFEDGGVVTVTQDSSLQDGEFIYKVKLRGTNFPSDGPVMQKKTMGWEASTERMYPEDGALKGEIKMRLKLKDGGHYDAEVKTTYMAK

SEQ ID NO: 1042 - DNA, 126 bp, Artificial
  modif. frag.; RFP F2F, with Met added @ position 1
  CDS (1)..(126): RFP F2F corresponds to aa residues 185-225(end) of mRFP
atgaagcccgtgcagctgcccggcgcctacaagaccgacatcaagctggacatcacctcccacaacgaggactacaccatcgtggaacagtacgagcgcgccgagggccgccactccaccggcgcc

SEQ ID NO: 1043 - protein, 42 aa, Artificial
  modif. frag.; RFP F2F, with Met added @ position 1
MKPVQLPGAYKTDIKLDITSHNEDYTIVEQYERAEGRHSTGA

SEQ ID NO: 1044 - DNA, 105 bp, Artificial
  modif. frag.; KFP F1A, with position 1 Met removed
  CDS (1)..(105): KFP F1A  corresponds to aa residues 1-36 of KFP1
gcctccctgctgaccgagaccatgcccttcaagaccaccatcgagggcaccgtgaacggccactgcttcaagtgcatcggcaagggcgagggcaaccccttcgag

SEQ ID NO: 1045 - protein, 35 aa, Artificial
  modif. frag.; KFP F1A, with position 1 Met removed
ASLLTETMPFKTTIEGTVNGHCFKCIGKGEGNPFE

SEQ ID NO: 1046 - DNA, 591 bp, Artificial
  modif. frag.; KFP F2A, with Met added @ position 1
  CDS (1)..(591): KFP F2A corresponds to aa residues 37-end of KFP1
atgggcacccaggagatgaagatcgaggtgatcgagggcggccccctgcccttcgccttccacatcctgtccacctcctgcatgtacggctccaagaccttcatcaagtacgtgtccggcatccccgactacttcaagcagtccttccccgagggcttcacctgggagcgcaccaccacctacgaggacggcggcttcctgaccgcccaccaggacacctccctggacggcgactgcctggtgtacaaggtgaagatcctgggtaacaacttccccgccgacggccccgtgatgcagaacaaggtcggccgctgggagcccggaaccgagatcgtgtacgaggtggacggcgtgctgcgcggccagtccctgatggccctgaagtgccccggcggccggcacctgacctgccacctgcacaccacctaccgctccaagaagcccgcctccgccctgaagatgcccggcttccacttcgaggaccaccgcatcgagatcatggaggaggtggagaagggcaagtgctacaagcagtacgaggccgccgtgggccgctactgcgacgccgccccctccaagctgggccacaac

SEQ ID NO: 1047 - protein, 197 aa, Artificial
  modif. frag.; KFP F2A, with Met added @ position 1
MGTQEMKIEVIEGGPLPFAFHILSTSCMYGSKTFIKYVSGIPDYFKQSFPEGFTWERTTTYEDGGFLTAHQDTSLDGDCLVYKVKILGNNFPADGPVMQNKVGRWEPGTEIVYEVDGVLRGQSLMALKCPGGRHLTCHLHTTYRSKKPASALKMPGFHFEDHRIEIMEEVEKGKCYKQYEAAVGRYCDAAPSKLGHN

SEQ ID NO: 1048 - DNA, 291 bp, Artificial
  modif. frag.; KFP F1B, with position 1 Met removed
  CDS (1)..(291): KFP F1B  corresponds to aa residues 1-98 of KFP1
gcctccctgctgaccgagaccatgcccttcaagaccaccatcgagggcaccgtgaacggccactgcttcaagtgcatcggcaagggcgagggcaaccccttcgagggcacccaggagatgaagatcgaggtgatcgagggcggccccctgcccttcgccttccacatcctgtccacctcctgcatgtacggctccaagaccttcatcaagtacgtgtccggcatccccgactacttcaagcagtccttccccgagggcttcacctgggagcgcaccaccacctacgaggac

SEQ ID NO: 1049 - protein, 97 aa, Artificial
  modif. frag.; KFP F1B, with position 1 Met removed
ASLLTETMPFKTTIEGTVNGHCFKCIGKGEGNPFEGTQEMKIEVIEGGPLPFAFHILSTSCMYGSKTFIKYVSGIPDYFKQSFPEGFTWERTTTYED

SEQ ID NO: 1050 - DNA, 405 bp, Artificial
  modif. frag.; KFP F2B, with Met added @ position 1
  CDS (1)..(405): KFP F2B corresponds to aa residues 99-end of KFP1
atgggcggcttcctgaccgcccaccaggacacctccctggacggcgactgcctggtgtacaaggtgaagatcctgggtaacaacttccccgccgacggccccgtgatgcagaacaaggtcggccgctgggagcccggaaccgagatcgtgtacgaggtggacggcgtgctgcgcggccagtccctgatggccctgaagtgccccggcggccggcacctgacctgccacctgcacaccacctaccgctccaagaagcccgcctccgccctgaagatgcccggcttccacttcgaggaccaccgcatcgagatcatggaggaggtggagaagggcaagtgctacaagcagtacgaggccgccgtgggccgctactgcgacgccgccccctccaagctgggccacaac

SEQ ID NO: 1051 - protein, 135 aa, Artificial
  modif. frag.; KFP F2B, with Met added @ position 1
MGGFLTAHQDTSLDGDCLVYKVKILGNNFPADGPVMQNKVGRWEPGTEIVYEVDGVLRGQSLMALKCPGGRHLTCHLHTTYRSKKPASALKMPGFHFEDHRIEIMEEVEKGKCYKQYEAAVGRYCDAAPSKLGHN

SEQ ID NO: 1052 - DNA, 456 bp, Artificial
  modif. frag.; KFP F1C, with position 1 Met removed
  CDS (1)..(456): KFP F1C  corresponds to aa residues 1-153 of KFP1
gcctccctgctgaccgagaccatgcccttcaagaccaccatcgagggcaccgtgaacggccactgcttcaagtgcatcggcaagggcgagggcaaccccttcgagggcacccaggagatgaagatcgaggtgatcgagggcggccccctgcccttcgccttccacatcctgtccacctcctgcatgtacggctccaagaccttcatcaagtacgtgtccggcatccccgactacttcaagcagtccttccccgagggcttcacctgggagcgcaccaccacctacgaggacggcggcttcctgaccgcccaccaggacacctccctggacggcgactgcctggtgtacaaggtgaagatcctgggtaacaacttccccgccgacggccccgtgatgcagaacaaggtcggccgctgggagcccggaaccgagatcgtgtacgaggtggacggcgtg

SEQ ID NO: 1053 - protein, 152 aa, Artificial
  modif. frag.; KFP F1C, with position 1 Met removed
ASLLTETMPFKTTIEGTVNGHCFKCIGKGEGNPFEGTQEMKIEVIEGGPLPFAFHILSTSCMYGSKTFIKYVSGIPDYFKQSFPEGFTWERTTTYEDGGFLTAHQDTSLDGDCLVYKVKILGNNFPADGPVMQNKVGRWEPGTEIVYEVDGV

SEQ ID NO: 1054 - DNA, 240 bp, Artificial
  modif. frag.; KFP F2C, with Met added @ position 1
  CDS (1)..(240): KFP F2C corresponds to aa residues 154-end of KFP1
atgctgcgcggccagtccctgatggccctgaagtgccccggcggccggcacctgacctgccacctgcacaccacctaccgctccaagaagcccgcctccgccctgaagatgcccggcttccacttcgaggaccaccgcatcgagatcatggaggaggtggagaagggcaagtgctacaagcagtacgaggccgccgtgggccgctactgcgacgccgccccctccaagctgggccacaac

SEQ ID NO: 1055 - protein, 80 aa, Artificial
  modif. frag.; KFP F2C, with Met added @ position 1
MLRGQSLMALKCPGGRHLTCHLHTTYRSKKPASALKMPGFHFEDHRIEIMEEVEKGKCYKQYEAAVGRYCDAAPSKLGHN

SEQ ID NO: 1056 - DNA, 333 bp, Artificial
  modif. frag.; KFP F1D, with position 1 Met removed
  CDS (1)..(333): KFP F1D  corresponds to aa residues 1-112 of KFP1
gcctccctgctgaccgagaccatgcccttcaagaccaccatcgagggcaccgtgaacggccactgcttcaagtgcatcggcaagggcgagggcaaccccttcgagggcacccaggagatgaagatcgaggtgatcgagggcggccccctgcccttcgccttccacatcctgtccacctcctgcatgtacggctccaagaccttcatcaagtacgtgtccggcatccccgactacttcaagcagtccttccccgagggcttcacctgggagcgcaccaccacctacgaggacggcggcttcctgaccgcccaccaggacacctccctggacggc

SEQ ID NO: 1057 - protein, 111 aa, Artificial
  modif. frag.; KFP F1D, with position 1 Met removed
ASLLTETMPFKTTIEGTVNGHCFKCIGKGEGNPFEGTQEMKIEVIEGGPLPFAFHILSTSCMYGSKTFIKYVSGIPDYFKQSFPEGFTWERTTTYEDGGFLTAHQDTSLDG

SEQ ID NO: 1058 - DNA, 363 bp, Artificial
  modif. frag.; KFP F2D, with Met added @ position 1
  CDS (1)..(363): KFP F2D corresponds to aa residues 113-end of KFP1
atggactgcctggtgtacaaggtgaagatcctgggtaacaacttccccgccgacggccccgtgatgcagaacaaggtcggccgctgggagcccggaaccgagatcgtgtacgaggtggacggcgtgctgcgcggccagtccctgatggccctgaagtgccccggcggccggcacctgacctgccacctgcacaccacctaccgctccaagaagcccgcctccgccctgaagatgcccggcttccacttcgaggaccaccgcatcgagatcatggaggaggtggagaagggcaagtgctacaagcagtacgaggccgccgtgggccgctactgcgacgccgccccctccaagctgggccacaac

SEQ ID NO: 1059 - protein, 121 aa, Artificial
  modif. frag.; KFP F2D, with Met added @ position 1
MDCLVYKVKILGNNFPADGPVMQNKVGRWEPGTEIVYEVDGVLRGQSLMALKCPGGRHLTCHLHTTYRSKKPASALKMPGFHFEDHRIEIMEEVEKGKCYKQYEAAVGRYCDAAPSKLGHN

SEQ ID NO: 1060 - DNA, 504 bp, Artificial
  modif. frag.; KFP F1E, with position 1 Met removed
  CDS (1)..(504): KFP F1E  corresponds to aa residues 1-169 of KFP1
gcctccctgctgaccgagaccatgcccttcaagaccaccatcgagggcaccgtgaacggccactgcttcaagtgcatcggcaagggcgagggcaaccccttcgagggcacccaggagatgaagatcgaggtgatcgagggcggccccctgcccttcgccttccacatcctgtccacctcctgcatgtacggctccaagaccttcatcaagtacgtgtccggcatccccgactacttcaagcagtccttccccgagggcttcacctgggagcgcaccaccacctacgaggacggcggcttcctgaccgcccaccaggacacctccctggacggcgactgcctggtgtacaaggtgaagatcctgggtaacaacttccccgccgacggccccgtgatgcagaacaaggtcggccgctgggagcccggaaccgagatcgtgtacgaggtggacggcgtgctgcgcggccagtccctgatggccctgaagtgccccggcggccggcac

SEQ ID NO: 1061 - protein, 168 aa, Artificial
  modif. frag.; KFP F1E, with position 1 Met removed
ASLLTETMPFKTTIEGTVNGHCFKCIGKGEGNPFEGTQEMKIEVIEGGPLPFAFHILSTSCMYGSKTFIKYVSGIPDYFKQSFPEGFTWERTTTYEDGGFLTAHQDTSLDGDCLVYKVKILGNNFPADGPVMQNKVGRWEPGTEIVYEVDGVLRGQSLMALKCPGGRH

SEQ ID NO: 1062 - DNA, 192 bp, Artificial
  modif. frag.; KFP F2E, with Met added @ position 1
  CDS (1)..(192): KFP F2E corresponds to aa residues 170-end of KFP1
atgctgacctgccacctgcacaccacctaccgctccaagaagcccgcctccgccctgaagatgcccggcttccacttcgaggaccaccgcatcgagatcatggaggaggtggagaagggcaagtgctacaagcagtacgaggccgccgtgggccgctactgcgacgccgccccctccaagctgggccacaac

SEQ ID NO: 1063 - protein, 64 aa, Artificial
  modif. frag.; KFP F2E, with Met added @ position 1
MLTCHLHTTYRSKKPASALKMPGFHFEDHRIEIMEEVEKGKCYKQYEAAVGRYCDAAPSKLGHN

SEQ ID NO: 1064 - DNA, 555 bp, Artificial
  modif. frag.; KFP F1F, with position 1 Met removed
  CDS (1)..(555): KFP F1F  corresponds to aa residues 1-186 of KFP1
gcctccctgctgaccgagaccatgcccttcaagaccaccatcgagggcaccgtgaacggccactgcttcaagtgcatcggcaagggcgagggcaaccccttcgagggcacccaggagatgaagatcgaggtgatcgagggcggccccctgcccttcgccttccacatcctgtccacctcctgcatgtacggctccaagaccttcatcaagtacgtgtccggcatccccgactacttcaagcagtccttccccgagggcttcacctgggagcgcaccaccacctacgaggacggcggcttcctgaccgcccaccaggacacctccctggacggcgactgcctggtgtacaaggtgaagatcctgggtaacaacttccccgccgacggccccgtgatgcagaacaaggtcggccgctgggagcccggaaccgagatcgtgtacgaggtggacggcgtgctgcgcggccagtccctgatggccctgaagtgccccggcggccggcacctgacctgccacctgcacaccacctaccgctccaagaagcccgcctccgcc

SEQ ID NO: 1065 - protein, 185 aa, Artificial
  modif. frag.; KFP F1F, with position 1 Met removed
ASLLTETMPFKTTIEGTVNGHCFKCIGKGEGNPFEGTQEMKIEVIEGGPLPFAFHILSTSCMYGSKTFIKYVSGIPDYFKQSFPEGFTWERTTTYEDGGFLTAHQDTSLDGDCLVYKVKILGNNFPADGPVMQNKVGRWEPGTEIVYEVDGVLRGQSLMALKCPGGRHLTCHLHTTYRSKKPASA

SEQ ID NO: 1066 - DNA, 141 bp, Artificial
  modif. frag.; KFP F2F, with Met added @ position 1
  CDS (1)..(141): KFP F2F corresponds to aa residues 187-end of KFP1
atgctgaagatgcccggcttccacttcgaggaccaccgcatcgagatcatggaggaggtggagaagggcaagtgctacaagcagtacgaggccgccgtgggccgctactgcgacgccgccccctccaagctgggccacaac

SEQ ID NO: 1067 - protein, 47 aa, Artificial
  modif. frag.; KFP F2F, with Met added @ position 1
MLKMPGFHFEDHRIEIMEEVEKGKCYKQYEAAVGRYCDAAPSKLGHN

What is claimed is:

1. A composition comprising complementary fragments of a fluorescent protein, said fragments generating a fluorescent detectable signal when associated.

2. The composition of claim 1 wherein said fragments are derived from a mutant fluorescent protein.

3. The composition of claim 2 wherein said complementary fragments differ from the corresponding fragments of the wild-type protein by at least one amino acid.

4. A composition comprising complementary fragments of a mutant fluorescent protein, said fragments generating a fluorescent detectable signal when associated, wherein each fragment is fused to a separate molecule.

5. The composition of claim 4 wherein said complementary fragments differ from the corresponding fragments of the wild-type protein by at least one amino acid.

6. Protein fragment complementation assays for the detection of molecular interactions comprising a reassembly of separate fragments from a fluorescing detectable protein wherein reassembly of the fragments is operated by the interaction of molecular domains fused to each fragment, wherein reassembly of the fragments is independent of other molecular processes and wherein said reassembly is detected by means of reconstitution of activity of said fluorescent detectable protein.

7. The assays of claim 6 wherein said fragments are derived from a mutant fluorescent protein.

8. A method for detecting biomolecular interactions said method comprising:
 (a) selecting an appropriate fluorescent detectable protein;
 (b) effecting fragmentation of said fluorescent detectable protein such that said fragmentation results in reversible loss of protein function;
 (c) fusing or attaching fragments of said fluorescent detectable protein separately to other molecules;
 (d) reassociating said protein fragments through interactions of the molecules that are fused or attached to said fragments; and
 (e) detecting the resulting fluorescence signal.

9. The method of claim 8 wherein said detectable reporter protein is a mutant fluorescent protein.

10. A composition comprising complementary fragments derived from a mutant fluorescent protein, wherein said complementary fragments differ from the corresponding fragments of the wild-type protein by at least one amino acid, wherein said fragments generate a fluorescent detectable signal when associated and wherein said fragments are selected from the group consisting of: Seq. ID No: 20 to Seq. ID No: 1067.

11. The composition of claim 1 wherein said fragments are further fused to a separate molecule.

* * * * *